US010119126B2

(12) United States Patent
Marty et al.

(10) Patent No.: US 10,119,126 B2
(45) Date of Patent: Nov. 6, 2018

(54) ENZYMES, ENZYME COMPONENTS AND USES THEREOF

(71) Applicant: BASF PLANT SCIENCE COMPANY GMBH, Ludwigshafen (DE)

(72) Inventors: Laurent Marty, Heidelberg (DE); Toralf Senger, Durham, NC (US)

(73) Assignee: BASF PLANT SCIENCE COMPANY GMBH, Ludwigshafen (DE)

( * ) Notice: Subject to any disclaimer, the term of this patent is extended or adjusted under 35 U.S.C. 154(b) by 0 days.

(21) Appl. No.: 15/864,798

(22) Filed: Jan. 8, 2018

(65) Prior Publication Data

US 2018/0142217 A1     May 24, 2018

Related U.S. Application Data

(63) Continuation of application No. 14/416,981, filed as application No. PCT/IB2013/056243 on Jul. 30, 2013, now Pat. No. 9,879,234.

(60) Provisional application No. 61/679,100, filed on Aug. 3, 2012.

(30) Foreign Application Priority Data

Aug. 3, 2012    (EP) ..................................... 12179241

(51) Int. Cl.
    *C12N 9/02*         (2006.01)
    *C12P 7/64*         (2006.01)

(52) U.S. Cl.
    CPC ........... *C12N 9/0071* (2013.01); *C12N 9/001* (2013.01); *C12P 7/6427* (2013.01); *C12Y 114/19* (2013.01)

(58) Field of Classification Search
None
See application file for complete search history.

(56) References Cited

U.S. PATENT DOCUMENTS

| 8,119,784 | B2 | 2/2012 | Zhu et al. |
| 2008/0155705 | A1 | 6/2008 | Zank et al. |
| 2013/0291228 | A1 | 10/2013 | Senger et al. |
| 2015/0203826 | A1 | 7/2015 | Marty et al. |

FOREIGN PATENT DOCUMENTS

| CN | 1860211 A | 11/2006 |
| CN | 101980595 A | 2/2011 |
| WO | WO-2008/022963 A2 | 2/2008 |

OTHER PUBLICATIONS

Arondel et al, Map-based cloning of a gene controlling omega-3 fatty acid desaturation in *Arabidopsis*, Science, 258(5086) : 1353-5 (1992).
Balvo, et al, Genetic connection between fatty acid metabolism and sporulation in Aspergillus nidulans, J.Biol. Chem, 276(28):25766-74 (2001).
Broadwater et al., Desaturation and hydroxylation. Residues 148 and 324 of *Arabidopsis* FAD2, in addition to substrate chain length, exert a major influence in partitioning of catalytic specificity, J. Biol. Chem., 277(18):15613-20 (2002).
Broun et al., Catalytic plasticity of fatty acid modification enzymes underlying chemical diversity of plant lipids, Science, 282(5392):1315-7 (1998).
Cases et al., Identification of a gene encoding an acyl CoA:diacylglycerol acyltransferase, a key enzyme in triacylglycerol synthesis, Proc. Natl. Acad. Sci. USA, 95(22): 13018-23 (1998).
Frentzen, Acyltransferases from basic science to modified seed oils, Fett/Lipid, pp. 161-166, vol. 100 (1998).
Genbank AAQ98793, delta-4 fatty acid desaturase [Pavlova lutheri] (Nov. 7, 2003).
Genbank AY926606.1, Pavlova salina delta-4 desaturase (D4Des) mRNA, complete cds (Dec. 1, 2006).
GenBank: Accession No. AY332747.1, Retrieved from the Internet: <https://www.ncbi.nlm.nih.gov/nuccore/AY332747.1?from=60&to=1397&sat=4&sat_key=3> (Retrieved on Mar. 8, 2017).
International Preliminary Report on Patentability, International Application No. PCT/IB2013/056243, dated Feb. 3, 2015.
International Search Report, International Application No. PCT/IB2013/056243, dated Feb. 6, 2014.
Knutzon et al., Identification of Delta5-desaturase from Mortierella alpina by heterologous expression in Bakers' yeast and canola, J. Biol. Chem., 273(45):29360-6 (1998).
Lu et al., An enzyme regulating triacylglycerol composition is encoded by the ROD1 gene of *Arabidopsis*, Proc. Natl. Acad. Sci. USA, 106(44): 18837-42 (2009).
Mantle et al., Differentiation of Claviceps purpurea in axenic culture, J. Gen. Microbiol., 93(2):321-34 (1976).
Mey et al., The biotrophic, non-appressorium-forming grass pathogen Claviceps purpurea needs a Fus3/Pmk1 homologous mitogen-activated protein kinase for colonization of rye ovarian tissue, Mol. Plant Microbe Interact. 15(4):303-12 (2002).
Okuley et al., *Arabidopsis* FAD2 gene encodes the enzyme that is essential for polyunsaturated lipid synthesis, Plant Cell, 6(1):147-58 (1994).
Qi et al, Production of very long chain polyunsaturated omega-3 and omega-6 fatty acids in plants, Nat. Biotechnol., 22:739-45, vo. 22 (2004).
Qui et al., Identification of a delta4 fatty acid desaturase from *Thraustochystrium* sp. involved in the biosynthesis of docosahexanoic acid by heterologous expression in *Saccharomyces cerevisiae* adn *Brassica juncea*, J. Biol. Chem., 276(34):31561-6 (2001).

(Continued)

*Primary Examiner* — Suzanne M Noakes
*Assistant Examiner* — Jae W Lee
(74) *Attorney, Agent, or Firm* — Marshall, Gerstein & Borun LLP

(57) ABSTRACT

The invention provides nucleic acid molecules which encodes a novel fatty acid desaturase, KCS, KCR and/or LACS from *Thraustochytrium aureum* and *Sphaeroforma arctica*. The invention also provides recombinant expression vectors containing the nucleic acid molecules, host cells into which the expression vectors have been introduced, and methods for large-scale production of long chain polyunsaturated fatty acids (LCPUFAs), e.g., ARA, EPA and DHA and for screening for delta-4 desaturases.

Figure 1:
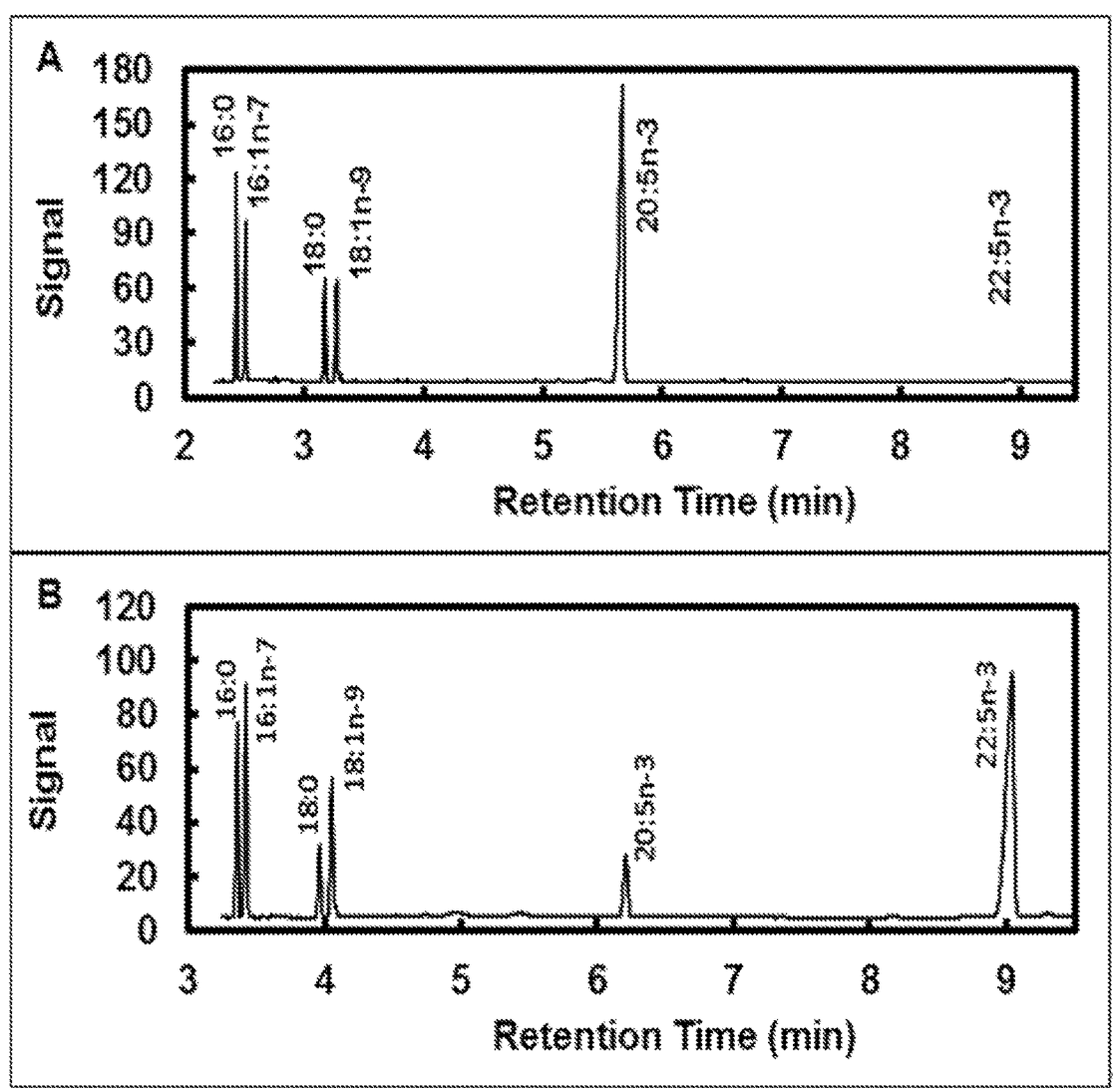

8 Claims, 24 Drawing Sheets
Specification includes a Sequence Listing.

(56) References Cited

OTHER PUBLICATIONS

Shanklin et al, Desaturation and related modifications of fatty acids, Plant Physiol. Plant Mol. Biol., 49:611-41 (1998).
Slabas, Acyltransferases and their role in the biosynthesis of lipids—opportunities for new oils, J.Plant Physiology, 158:505-13 (2001).
Tonon et al., Identification of a very long chain polyunsaturated fatty acid delta4-desaturase from the microalga *Pavlova lutheri*, FEBS Lett., 553:440-4 (2003).
Tudzinski et al, Biotechnology and genetics of ergot alkaloids, App. Microbiol. Biotechnol., 57:593-605 (2001).
UniProt No. D6NST0, Delta-4 fatty acid desaturase [Pavlova viridis].
Vrinten et al., Biosynthesis of long chain polyunsaturated fatty acids in the marine ichtyosporean *Sphaeroforma aractica*, Lipids, 48:263-74 (2013).
Xu et al., Heterologous overexpression of a novel delta-4 desaturase gene from the marine microalga Pavlova viridis in *Escherichia coli* as a Mistic fusion, World J. Microbiol. Biotechnol., 27:2931-7 (2011).
Zank, Cloning and functional expression of the first plant fatty acid elongase specific for delta6-polyunsaturated fatty acids, Biochemical Society Transactions, 28:654-8 (2000).

Figure 2

```
Q6VPV2_PAVLU                                    ------------------------------------------------
D6NST0_9EUKA                                    ------------------------------------------------
A0PJ29_9EUKA                                    ------------------------------------------------
d4Des(Sa)                                       ------------------------------------------------
d4Des(Tc)                                       ------------------------------------------------
Q8S3C0_9STRA-Thraustochytrium_sp_ATCC21685       ---------------------------------MPPSAASE-GG--VAE
Q45G27_9STRA-Thraustochytrium_sp_FJN-10          --------------------------------MPPSAAKDAGG--AAE
Q8GZS4_9STRA-Thraustochytrium_aureum             --------------------------------MPPSAAKQMG--ASTG
Q8GZS5_9STRA-Thraustochytrium_aureum             --------------------------------MPPHSRTKVVSDSDPE
Q8GZS6_9STRA-Thraustochytrium_aureum             ---------------------------------------------MTVG
Q8GZS3_9STRA-Thraustochytrium_aureum             ---------------------------------------------MTVG
B8LEI2_THAPS-Thalassiosira_pseudonana            -----------------------------------MCNGNLPASTAQLK
Q4G2T0_THAPS-Thalassiosira_pseudonana            -----------------------------------MGNGNLPASTAQLK
Q6WNG7_EUGGR-Euglena_gracilis                    MLVLFGNFYVKQYSQKNGKPENGATPENGAKPQPCENGTVEKRENDTANVRPTRPAGPPP
F2U823_SALS5-Salpingoeca                         ------------------------------------------------
Q4QFK0_LEIMA-Leishmania_major                    ------------------------------------------------

Q6VPV2_PAVLU                                    -------LRA--AEVASYTRKAVDERPDLTIVGDA-----------VYDAK
D6NST0_9EUKA                                    -------LRA--AELASYTRKAVTERSDLTIVGDA-----------VYDAK
A0PJ29_9EUKA                                    -------VHAGVTDSSAFTRKDVADRPDLTIVGDS-----------VYDAK
d4Des(Sa)                                       -------LSDLKMKHFTREEILNHTNDKYCILEDG-----------VYDLT
d4Des(Tc)                                       ----------YDEEIPFEQVRAHNKPDDAWCAIHGH----------VYDVT
Q8S3C0_9STRA-Thraustochytrium_sp_ATCC21685       ----------YDEEIPFEQVRAHNKPDDAWCAIHGH----------VYDVT
Q45G27_9STRA-Thraustochytrium_sp_FJN-10          ----------YDGEIPFEQVRAHNKPDDAWCAIHGH----------VYDVT
Q8GZS4_9STRA-Thraustochytrium_aureum             ----------FDETVTMDTVRNHNMPDDAWCAIHGT----------VYDIT
Q8GZS5_9STRA-Thraustochytrium_aureum             ----------FDETVTMDTVRNHNMPDDAWCAIHGT----------VYDIT
Q8GZS6_9STRA-Thraustochytrium_aureum             ----------FDETVTMDTVRNHNMPDDAWCAIHGT----------VYDIT
Q8GZS3_9STRA-Thraustochytrium_aureum             ----------FDETVTMDTVRNHNMPDDAWCAIHGT----------VYDIT
B8LEI2_THAPS-Thalassiosira_pseudonana            ----STSKPQQQHEHRTISKSELAQHNTPKSAWCAVHSTPATDPSHSNNKQHAHLVLDIT
Q4G2T0_THAPS-Thalassiosira_pseudonana            ----STSKPQQQHEHRTISKSELAQHNTPKSAWCAVHSTPATDPSHSNNKQHAHLVLDIT
Q6WNG7_EUGGR-Euglena_gracilis                    ATYYDSLAVSGQGKERLFTTDEVRRHILPTDGWLTCHEG-----------VYDVT
F2U823_SALS5-Salpingoeca                         ---------------MTTVVVDGR----------------------AYDGE
Q4QFK0_LEIMA-Leishmania_major                    ----------MNQCCHSHLSTLEPMPDLKKDVLSIDGI---------YYDTE
```

Figure 2 (continued)

```
Q6VPV2_PAVLU                             LLR-------GKTLLLSVFLGLVFAWIGLNIQHDANHGALSRHSVINYCLGYAQDWIGGNM
D6NST0_9EUKA                             LLR-------GKTLFLSVLLGLVFAWIGLNIQHDANHGALSRYPAVNYCLGYMQDWIGGNM
A0PJ29_9EUKA                             LYA-------GKRLLPSIVLGWLFALIGLNIQHDANHGALSKSASVNLALGLCQDWIGGSM
d4Des(Sa)                                IAS-------GPTIPLAIVSGLLYAAIGLNIQHDANHGSVSRNPMVNRLFGYSQDWIGGSR
d4Des(Tc)                                CT----LDPSFGAILAAMSLGVFAAFVGTCIQHDGNHGAFAQSRWVNKVAGWTLDMIGASG
Q8S3C0_9STRA-Thraustochytrium_sp_ATCC21685  CT----LDPSFGAILAAMSLGVFAAFVGTCIQHDGNHGAFAQSRWVNKVAGWTLDMIGASG
Q45G27_9STRA-Thraustochytrium_sp_FJN-10   CT----LDPHGGAMVAAVTLGVFAAFVGTCIQHDGSHGAFSKSRFMNKAAGWTLDMIGASA
Q8GZS4_9STRA-Thraustochytrium_aureum      CV----LDPHGGAMVAAVTLGVFAAFVGTCIQHDGSHGAFSKSRFMNKAAGWTLDMIGASA
Q8GZS5_9STRA-Thraustochytrium_aureum      CV----LDPHGGAMVAAVTLGVFAAFVGTCIQHDGSHGAFSKSRFMNKAAGWTLDMIGASA
Q8GZS6_9STRA-Thraustochytrium_aureum      CV----LDPHGGAMVAAVTLGVFAAFVGTCIQHDGSHGAFSKSRFMNKAAGWTLDMIGASA
Q8GZS3_9STRA-Thraustochytrium_aureum      CV----LDPHGGAMVAAVTLGVFAAFVGTCIQHDGSHGAFSKSRFMNKAAGWTLDMIGASA
B8LEI2_THAPS-Thalassiosira_pseudonana     YTTSDIDQYGIAIAYSIGMGTFAAFIGTCIQHDGNHGAFAQNKLLNKLAGWTLDMIGASA
Q4G2T0_THAPS-Thalassiosira_pseudonana     YTTSDIDQYGIAIAYSIGMGTFAAFIGTCIQHDGNHGAFAQNKLLNKLAGWTLDMIGASA
Q6WNG7_EUGGR-Euglena_gracilis             VA--------HKSFLWAAVWGFAGSHVGLSIQHDGNHGAFSRNTLVNRLAGWGMDLIGASS
F2U823_SALS5-Salpingoeca                  LIT-------APTLLKGFVVGLLVALIGLNIQHDANHGSLSPKPWVNTLFGFAQDWIGGNS
Q4QFK0_LEIMA-Leishmania_major             LFY-------RRAYFLTVIQSLSMAMVGLNVQHDANHGALSCDWRVNRILGLSQDLLGGSS Q6VPV2_PAVLU                             VLWLQEHVVMHHLHT----------------NDVDADPDQ-KAHGVLRLKPTDGW
D6NST0_9EUKA                             VLWLQEHVVMHHLHT----------------NDVDHDPDQ-KAHGALRLKPTDSW
A0PJ29_9EUKA                             ILWLQEHVVMHHLHT----------------NDVDKDPDQ-KAHGALRLKPTDAW
d4Des(Sa)                                MLWIRQHVVGHHTHC----------------NRHQHDPDV-KGGSVITLSRYSLP
d4Des(Tc)                                MTWEFQHVIGHHPYTNLIEEENGLQKVSGKKMDTKLADQESDPDVFSTYPMMRLHPWHQK
Q8S3C0_9STRA-Thraustochytrium_sp_ATCC21685  MTWEFQHVIGHHPYTNLIEEENGLQKVSGKKMDTKLADQESDPDVFSTYPMMRLHPWHQK
Q45G27_9STRA-Thraustochytrium_sp_FJN-10   MTWEFQHALGHHPYTNLIEEENGLQKVSGKKMDTKLADQESDPDVFSTYPMMRLHPWHQK
Q8GZS4_9STRA-Thraustochytrium_aureum      MTWEMQHVIGHHPYTNLIEMENGLAKVKGADVDPKKVDQESDPDVFSTYPMLRLHPWHRQ
Q8GZS5_9STRA-Thraustochytrium_aureum      MTWEMQHVIGHHPYTNLIEMENGLAKVKGADVDPKKVDQESDPDVFSTYPMLRLHPWHRQ
Q8GZS6_9STRA-Thraustochytrium_aureum      MTWEMQHVIGHHPYTNLIEMENGLAKVKGADVDPKKVDQESDPDVFSTYPMLRLHPWHRQ
Q8GZS3_9STRA-Thraustochytrium_aureum      MTWEMQHVIGHHPYTNLIEMENGLAKVKGADVDPKKVDQESDPDVFSTYPMLRLHPWHRQ
B8LEI2_THAPS-Thalassiosira_pseudonana     FTWELQHMIGHHPYTNVLDGVEEERKERGEDVALEEKDQESDPDVFSSFPLMRMHPHHTT
Q4G2T0_THAPS-Thalassiosira_pseudonana     FTWELQHMIGHHPYTNVLDGVEEERKERGEDVALEEKDQESDPDVFSSFPLMRMHPHHTT
Q6WNG7_EUGGR-Euglena_gracilis             TVWEYQHVIGHHQYTNLVS------------DTLFSLPENDPDVFSSYPLMRMHPDTAW
F2U823_SALS5-Salpingoeca                  LLWLQQHVAIHHVEC----------------NDLDHDKDM-LETPLLRFSPLHGK
Q4QFK0_LEIMA-Leishmania_major             ISWIVNHDYVHHVYT----------------NEPGRDADL-EIP-LLRLHSGIPV
```

Figure 2 (continued)

```
Q6VPV2_PAVLU                                    MPWHALQQLYILPGEAMYAFKLLFLDALELLAWRWEG--EKISPLARAL-FAPAVACKLG
D6NST0_9EUKA                                    LPWHSLQQVYILPGEAMYAFKLLFLSLDALELLAWRWEG--EPISQLAAPL-YAPAVVCKLA
A0PJ29_9EUKA                                    SPMHWLQHLYLLPGETMYAFKLLFLDISELVMWRWEG--EPISKLAGYL-FMPSLLLKLT
d4Des(Sa)                                       KEFHHIQQYYFLPLIQLLGFQWVFLGLHDLIEMKYKG--EKLPESYRKE-RNIAIGLRVF
d4Des(Tc)                                       RWYHRFQHIYGPFIFGFMTINKVVTQDVGVVLRKRLFQIDAECRYASPMYVARFWIMKAL
Q8S3C0_9STRA-Thraustochytrium_sp_ATCC21685       RWYHRFQHIYGPFIFGFMTINKVVTQDVGVVLRKRLFQIDAECRYASPMYVARFWIMKAL
Q45G27_9STRA-Thraustochytrium_sp_FJN-10          RWYHRFQHIYGPFIFGFMTINKVVTQDVGVVFRKRLFQIDAECRYASPMYVARFWIMKAL
Q8GZS4_9STRA-Thraustochytrium_aureum             RFYHKFQHLYAPFIFGFMTINKVISQDVGVVLRKRLFQIDANCRYGSPWVVARFWIMKLL
Q8GZS5_9STRA-Thraustochytrium_aureum             RFYHKFQHLYAPFIFGFMTINKVISQDVGVVLRKRLFQIDANCRYGSPWVVARFWIMKLL
Q8GZS6_9STRA-Thraustochytrium_aureum             RFYHKFQHLYAPLIFGFMTINKVISQDVGVVLRKRLFQIDANCRYGSPWNVARFWIMKLL
Q8GZS3_9STRA-Thraustochytrium_aureum             RFYHKFQHLYAPFIFGSMTINKVISQDVGVVLRKRLFQIDANCRYGSPWYVARFWIMKLL
B8LEI2_THAPS-Thalassiosira_pseudonana            SWYHKYQHLYAPPLFALMTLAKVFQQDFEVATSGRLYHIDANVRYGSVWNVMRFWAMKVI
Q4G2T0_THAPS-Thalassiosira_pseudonana            SWYHKYQHLYAPPLFALMTLAKVFQQDFEVATSGRLYHIDANVRYGSVWNVMRFWAMKVI
Q6WNG7_EUGGR-Euglena_gracilis                    QPHHRFQHLFAFPLFALMTISKVLTSDFAVCLSMKKGSIDCSSRLVPLEGQLLFWGAKLA
F2U823_SALS5-Salpingoeca                         YAWQALQHVYFVLLEAGYATKVLLADWYNLLMNMYEG--VPISPLVRPWRWASVAARVV
Q4QFK0_LEIMA-Leishmania_major                    RLAHCLQQFYIFFLEAVFGPVHVLFN----IIFLAKG--PSEKQRLIKTQWVVSLCMLSI Q6VPV2_PAVLU                                    FWARFVALPLWLQPTVHTALCICATVCTGSFYLAFFFFISHNFDGVGSVGPKG------
D6NST0_9EUKA                                    FWARFVALPLWLQPSLHTAACICATVCTGSFYLAFFFFISHNFDGVASVGPQG------
A0PJ29_9EUKA                                    FWARFVALPLYLAPSVHTAVCIAATVMTGSFYLAFFFFISHNFEGVASVGPDGS------
d4Des(Sa)                                       FFIRKFVVPFALHFSWYTLLCTYLWMAIAALYLGFFFILSHIFVGAKSLPEDAK------
d4Des(Tc)                                       TVLYMVALPCYMQGPWHGLKLFAIAHFTCGEVLATMFIVNHIIEGVSYASKDAVKGT---
Q8S3C0_9STRA-Thraustochytrium_sp_ATCC21685       TVLYMVALPCYMQGPWHGLKLFAIAHFTCGEVLATMFIVNHIIEGVSYASKDAVKGT---
Q45G27_9STRA-Thraustochytrium_sp_FJN-10          TVLYMVALPCYMQGPWHGLKLFAIAHFTCGEVLATMFIVNHVIEGVSYASKDAVKGT---
Q8GZS4_9STRA-Thraustochytrium_aureum             TTLYMVALPMYMQGPAQGLKLFFMAHFTCGEVLATMFIVNHIIEGVSYASKDAVKGV---
Q8GZS5_9STRA-Thraustochytrium_aureum             TTLYMVALPMYMQGPAQGLKLFFMAHFTCGEVLATMFIVNHIIEGVSYASKDAVKGV---
Q8GZS6_9STRA-Thraustochytrium_aureum             TTLYTVALPMYMQGPAQGLKLFFMAHFTCGEVLATMFIVNHIIEGVSYASKDAVKGV---
Q8GZS3_9STRA-Thraustochytrium_aureum             TTLYMVALPMYMQGPAQGLKLFFMAHFTCGEVLATMFIVNHIIEGVSYASKDAVKGV---
B8LEI2_THAPS-Thalassiosira_pseudonana            TMGYMMGLPIYFHGVLRGVGLFVIGHLACGELLATMFIVNHVIEGVSYGTKDLVGGASHG
Q4G2T0_THAPS-Thalassiosira_pseudonana            TMGYMMGLPIYFHGVLRGVGLFVIGHLACGELLATMFIVNHVIEGVSYGTKDLVGGASHG
Q6WNG7_EUGGR-Euglena_gracilis                    NFLLQIVLPCYLHGTAMGLALFSVAHLVSGEYLAICFIINHISESCEFMN----------
F2U823_SALS5-Salpingoeca                         WTLRLIVIPLYLHSWQVYLPCLAVMAMVGGFYLAFFFLLSHNFEGVYHVLVPSSDPV---
Q4QFK0_LEIMA-Leishmania_major                    IPYRLLCNFLHATSFCDGLMSCVLQYAFGGFYLAYFFLLSHNFDGAKKVGTSD------
```

Figure 2 (continued)

Figure 2 (continued)

```
Q6VPV2_PAVLU                              SMLQHMGKMGTRPG--AEKGGKAE----------------------------------
D6NST0_9EUKA                              AMMSHLGKMAARPTS-ADKLARPSEKSSVECRLRLGAACARGSQASDAASLISWLG
A0PJ29_9EUKA                              STLRHMYALGRRPRSKAE--------------------------------------
d4Des(Sa)                                 STFRQVKALGSVAVYN-EFMEGL---------------------------------
d4Des(Tc)                                 KMLEHLRQLGNEETHESWQRAA----------------------------------
Q8S3C0_9STRA-Thraustochytrium_sp_ATCC21685 KMLEHLRQLGNEETHESWQRAA----------------------------------
Q45G27_9STRA-Thraustochytrium_sp_FJN-10    KMLEHLRRLGNEETHESWQRAA----------------------------------
Q8GZS4_9STRA-Thraustochytrium_aureum       KMLSHLRTLGNED-LTAWST------------------------------------
Q8GZS5_9STRA-Thraustochytrium_aureum       KMLSHLRTLGNED-LTARST------------------------------------
Q8GZS6_9STRA-Thraustochytrium_aureum       KMLSHLRTLGNED-LTAWST------------------------------------
Q8GZS3_9STRA-Thraustochytrium_aureum       KMLSHLRTLGNED-LTAWST------------------------------------
B8LEI2_THAPS-Thalassiosira_pseudonana      KMISHLKFLGKAKCE-----------------------------------------
Q4G2T0_THAPS-Thalassiosira_pseudonana      KMISHLKFLGKAKCE-----------------------------------------
Q6WNG7_EUGGR-Euglena_gracilis              GMVQHLRLMGAPPVPTNGDKKS----------------------------------
F2U823_SALS5-Salpingoeca                  STSNFLRAQGISSL--------------------------MKRKV-----------
Q4QFK0_LEIMA-Leishmania_major             STFRHMEQYGRGRE--------------------------KRKSA-----------
```

Figure 2 (continued)

Figure 3

>SEQ-87 - 92.6% sequence identity to SEQ ID NO 79
MPPHSRTKVGDPELSDLMKHFTREEILNHTNDDYCILEDGVYDLVNFRDKHPGGDVVDFFPGQDATPHFYMYHQYESPPSVLAEYKVGSIARDDSYVYHTPLMKQICSEVRKV
MPMQEGWAPPSWYIKACAILAATLYTDYLWIASGPTIPLAIVSGLLYAAIGLNIQHDANHGSVSRNPMVNRLFGYSQDWIGGSRMLWIQQHVGHHTHCNRIQHDPDVKGGSV
IRLSRYSLPKPFHHIQQYFLPLPEQLLGFQWVFLGAHDLIEMRYKGEKLPESYRKERNIAIGLRVFFFVRKFAVPLALHFSWYTLLCTYLWMCIAALYLGFFFILSHIFVGAK
SLPEDANIDWARHQIESSSNVCGEKLGISNGGLNFQIEHHLFPRMSHAHYSKIQPVVQKVCEENGVNYKKFGTIGSNLGSLFRQLKALGSVAIYEFMEGL >SEQ-88 - 91.9% sequence identity to SEQ ID NO 79
MPPHSRTKGSDPELSDMKHFTREEILNHTRDKYCILEDGVYDLTNFRDKHPGGDFLDLFPGQDATPHFYMLHQKESPPSVLAEYKVGSLARDDSYTHHTALMKQIKSAVRKVM
PMQEWWAPPSWYIKACAILAATLYTDYLWIASGPTIFLAIVSGLLYAAIGLNIQHDANHGSVSRNPVVNRLFGYSQDWIGGSRMLWIRQHVGHHTHCNRHQHDPDVKGGSVI
TLSRYSLPKPWHHIQQYFLPLIQLLGFQWVFLGLHDLIEMKYKGEKIPESYRKERNIAIGCRVFFFVRKFAVPFALHFSWYTLLCTYLWMAIGAFYLGFFFILSHNFVGIKS
LPEDANIEWARHQIESSSNVCGEKLGISNGGLNYQIEHHLFPRMSHAHYSKIQPVVQKVCEENGVNYKHFGTILSNLDSTFRQVGALGAVAIYEFMAGL >SEQ-89 - 91.7% sequence identity to SEQ ID NO 79
MPPHSRTKVSDPELSDMKHFTREEILDHTNDKYCILEDGVYDLTNFRDKHPGGDVLDFFPGQDATPHFYELHRYESLPSVLAEYKVGSVARDDSYVYATPLMKQIKSAVRKVI
PMQEWWAPPSWWIKACALLAAALYTDYLWIASGPTIPLAIVIGLLYAAIGLNIQHDANHGSISRNPMVNRLFGYSQDWIGGSRMLWIRQHVGHHTHCNRHDHDPDVKGGSVI
TLSPYSLPKEFHHIQQLYFLPLEQLLGFQWVFLGLHDLIEWKYKGEKLPELYRKERNIAIGCRIFFFARKFVIPFALHFSWYTLLCVYLWMATASLYLGFFFILSHIFIGAKS
LPEDANIDWARHQIESSSNVGGEKLGILNGGLNYQIEHHLFPRMSHAHYSKIQPVVQKVCEENGVNYKKFGTILSNLDSMFRHVKALGSVAVEFMAGL >SEQ-90 - 91.7% sequence identity to SEQ ID NO 79
MPPHSRTKVSDAELSDMKHFTRERILNHTNDKICILGDGVYDLSNFRDKHPGGDVLDFFPGQDATPHFYMFHKYASLPSVLAEYKVGSLARDDSYVQHTELMKQIKSAVRAVM
PMQEWWAPPSWYIKACALAATLYLDYLWIARGPTIFLGIVSGLLYAAIGLNIQHDANHGSVSRNPMVNRLFGYSQDWIGGSRVLWIRQHVGHHTHTNDHQHDPDVKGGGVI
KLSPVSLPLEFHHIQQYFFLPLDQLLGFQWVFLGLHDLIEMKWKGEKLPELYRKEYNIAIGLRVFFFIRKVVPPFALHFSWYTLICTYLWMATAALYLAFFILSHIFVGAKS
LPEDAKNIDWARHQIESSSNVCGEKLGISNGGLNYQIEHHLFPRMNHAHYSKIEPVVQKVCEENGVNYKKFGTILSNLDSTFRQVKALGSVPVYEFMEGL >SEQ-91 - 91.7% sequence identity to SEQ ID NO 79
MPPSSRKVSDPELSDMKHFTRERILNHTNDKYCIVEDGVYDLPNFRDKHPGGDVLDFFGGQDATPHFFMFHQYESLPSVLAEYKVGSLARDDSYVYHTELMKQIKSAVRKVI
PMQEWWAPPSWYIKACAILAATLYTDYLWIAKGPTIPLAIVIGLLYAAIGLNIQHDANHGSLSRNPMVNRLFGYSQDWIGGSRVIWIRQHVGHHTHCNRIQHDPDVKGGSVI
TLSRYSLPMEFHHIQQYFLPLDQLLGFQWVFLGLHELIEMKWKGEKLPESYRKERNIAVGCRVFFFARKFVVPPFALEFSWYTLICTYLWMAIAAFYLGFFFILSHIFVGAKS
LGEDAKNIDWARHQIESSSNVCGEWLGILNGGLNYGIEHHLFPRMNHAHYSKIQPVVQKVCEENGVNYKKFGTILSNLDSMFRQVKALGSVAVEFMEGL >SEQ-92 - 91.7% sequence identity to SEQ ID NO 79
MPPYSRTEVVSDPELKDMEHFSREEILNHTNDRKYCILGDGVYDLTNFRDKHPGGEFLSFFPGQDATPHFWMLHQRESLPGVLAEYKVGSVARDDSYVYHDPLMKRICSAVRGV
MPMQEWWAPPSWYIKACAILAATLYTDYLWIASGPTIPLAIVSGLLYAAIGLNIQHDANHGSLRNPAIGLRLFFFIRKKVVGLHDLIEIYRKERNPAIGLRLFFFIRKFVVGIK
ITLSPYSLPKEFHHIQQLYFLPLIQLLGFQWVFLGLHDLIEMKYKGEKLPEIYRKERNPAIGLRLFFFIRKFVVPLALHFSWYTLLCTYLWMAIAALYLGFFFILSHIFVGIK
SLPEDANIDWARHQIESSSNVCGEKLGIMNGGLNYQIEHHLFPRMSHAHYSKIQPVVQKVCEENGVNYKHFGTILSNLDSTFRQVKALGSVPTYEFLGGL >SEQ-93 - 91.7% sequence identity to SEQ ID NO 79
MPPHSRTKVSDDPELSDLMKHFAREEILNDNDDYCILEDGVYDLTNFRDKHPGGDVLDFFPGQDATPHFYMFHQYESLPSVLAKYKVGSVARDDSYVYHTPLMLQIKSEVRA
VLPMQEWWAPPSWYIKACAILAATLYTDYLWIASGPTIFLAIVSGLLYAAIGLNIQHDANHGSVSRNPMVNRLFGYSQDWIGGSRMLWIRQHVGHHTCNDHQHDPDVKGGS
AITLSPTSLPKEFHHIQQYYFLPLDQLYGFQWVFLGLHDLIEMKYEGEKLPEIYRKERNIAIGLRVFFVRKFAIPFALHFSWYTLLCTYLWMAIAALYLGFFILSHIFVGV
KSLGEDGKNIDWARHQIESSSNVCGEKLGISNGGLNYQIEHHLFPRMNHAHYSTIQPIVQRVCEENGVNYKKFGTILSNLDSTFSQIKALGSVAVYEFMEKI >SEQ-94 - 91.5% sequence identity to SEQ ID NO 79
MPPHSRTKVSDPELSDMKHFARERIANHTNDKYCILEDGVYDLTNFRDKHPGGDVLDIFPGQDATPHFYMYHQKEWPPSVLAEYKVGSVARDDSYVYHTPLQKQLKSAVRKVM
PKGSWWAPPSWYIKACAILAATLYLDYLWILSGPTIPLAIVIGLLYAAIGLNIQHDANHGSVSRNPMVNRLFGYGQDWIGGSRMLWIRQHVGHHTCNRVQHDPDIKGGSVI
TLSRYSLPLEFHHIQQYYFLPLEQLLGFQWVFLGAHDLIEMKYKGEKLPESYRKEYNIAIGLRVFFWIRKFVVPFALHFSWYTLLCTYLWMATAALYLGFFILSHIFIGAKS
LPEDANIDWARHQIESSSNVCGDKLGISNGGLNYQIEHHLFPRMSHAHYSKIQPVVQKVCEEMGVNYKKFGTIGSNLDSTFRYVKALGSVAVEFMEGL >SEQ-95 - 91.5% sequence identity to SEQ ID NO 79
MPPHSRTKVSDPELSDMKHFTREKILNHTNDKYCILGDGVYDCTNFRDKHPGGDFLDFFGGQDATPHFYQLHQYESLPSVLAKYKVGSVARDDSYVHHTELMKQIKSAVRAVM
PMGEWWAPPSWYIKACAILAATLYTDYLWIASGPTIPLAIVIGLLYAAIGLNIQHDANHGAVSRNPMVNRLFGYSQDWIGGSRMLWIRQHVGHHLHCNRIQHDPDVKGGSVI
TLSRYSLPMEFHHIQQYYFLPLIQLYGFQWVFLGLNDLIEMKYKGEKLPESYRKERNIAIGCRVFFFIRKFAVPFALHFSWYTLLCTCLWMAIAALYLGFFILSHIFVGAKS
LPEDANIDWARHQIESSSNVGGEWLGISNGGLNYQIEHHLFPRMSHAHYSKIQPIVQKVCEENGVNYKHFPTILSNLGSTFRYIGALGSVPVYEFMEGL >SEQ-96 - 91.5% sequence identity to SEQ ID NO 79
MPPHSRTKVSDPELSDMKHFTYEEILNHTNDKYCILEDGVYDLTNFRDKHPGGDVLDFFPGQDATPHFYQLHQREWPPSIMAEYKVGSVDRDDSYVYHTSLMKQICCAVRKVM
PRQSWWAPPSWYIKACAILAATLYLDYLWIASGPTILLAIVSGLLYAAIGLNIQHDANHGSLSRNPMVNRLFGYSQDWIGGSRMLWIRQHVGHHTCNRHQHDPDVKGGSAI
TLSPYSLPKEFHHIQQYYFLPLIQLYGFQWVFLGLHDLIEMKYKGEPLSEIYRKERNPAIGLRIFFFIRKFVVPFALHFSWYTLLCTYLWMAIAALYLGFFILSHIFVGAKS
LPEDANIDWARHQIESSSNVCGEKLGIMNGGLNYQIEHHLFPRMSHAHYSKIQPVVQKICEDNGVNYKKFGTILASNLDSTFRQVKALGSVAVEFMEKL >SEQ-97 - 91.2% sequence identity to SEQ ID NO 79
MPPHSRTKGSDPELSDMKHFTREEKLNHTRDKICILGDGVYDLVCFRDEHPGGDVVDFFPGQDATPHFYMLHQYEWLPSVLAEYKVGSVARDDSYVYHTPLMKQIKSAVRAVM
PMQEGWAPPSWYIKACALLVATLYTDYLWIASGPTIPLAIVSGLLYAAIGLNIQHDANHGSVSRNPVVNRLFGYSQDWIGGSRMLWIRQHVGHHTCNDHQHDPDIKGGSVI
TLKRYDLWLPFHHIQQYYFLPGIQLLGFQWVFLGLHDLIEMKYKGEKLPPSYRKLRNIAIGLRVFFFIRKFVVPFALHFSWYTLLCIYLWMAIAALYLAFFILSHIFVGVKS
LPEDANIDWARHQIESSSNVCGEKLGISNGGLNYQIEHHLFPRMSHAHYSKIQPVVQKVCEENGINYKKFGTIASNLDSTFRQVKALGSVPVEFMEGL >SEQ-98 - 91.2% sequence identity to SEQ ID NO 79
MPPHARTKVSDPELSDMKHFTREEILNHTNDDYCILGDGVYDSTNFRDKHPGGDVLDFFPGQDATPHFYMLHQYESLPSVLARYKVGSVARDDSFTYHTPLMKQIKSEVRKIL
PMGEWWAPPSWYIKACALLAATLYLDYLWIASGPTIPLAIVSGLLYAAIGLNIQHDANHGSLSRNPVVNRLFGYSQDRVLWIQQHVGHHTCNRHQHDPDVKGGSVI
TLSRYSLPKEFHHIQQYYFLPLEQLLGFQWVFLGLNDLIEWKYKGEKLPESYRKDRAIAIGLRVFFVIPFALHFSWYTLLCVYLWMAIAALYLCFFFILSHIFVGAGS
LPEDANIDWARHQIESSSNVCGEKLGILNGGLNYQIEHHLFPRMSHAHYSKIAPVVQKVCEENGVNYKKFGTILSNLDATFRQVKALGSVAVEFMEKL

Figure 3 (continued)

>SEQ-99 - 91% sequence identity to SEQ ID NO 79
MPPHSATKGSDVPELSDAKHFAREEILNHTRDKYCILGDGVYDSTAFRDKHPGGDYLDFFPGQDATPHFYQFHQYASLPSVLAEYKVGSVARDDSYVQHTELMKQICSAVRKV
MPMQEWWAPPSWYIKACALLAATLYTDYLMIASGPTIPLAIVSGLLYAWIGLNIQHDANHGSVSRNPMVNRLFGYSQDWIGGSRMLWIRKHVVGHHTHCNRVQHDPDVKGGSV
ITLSRYSLPLEWHHIQQIYFLPLIQLYGFQWVFLGLHDLLEMKYKGEKLPPIYRKERNIAIGCRVFFFIRKFVVPFALHFTWYTLLCTYLWMAIAALYLGFFFILSHIFVGAK
SLPPDANIDWARHQIESSSNVCGEKLGIINGGLNYQIEHHLFPRMSHSHYSKIQPVVQKVCEENGVNYKKFGTILSNLDSTFKQVKALGSVAVYEFMEGL >SEQ-100 - 91% sequence identity to SEQ ID NO 79
MPPHSRTEVSDPELSDLMKHFTREEILNHNNDKYCILEDGVYDLTCFRDKHPGGDVLDFFPGQDATPGFYMLHQYASPPSVLAEYKVGSVERDDSYVQHTSGMKQIKSAVRAV
MPMQEWWAPPSWWIKACAILAATLYTDYLMIASGPTIPLAIVIGLLYAAIGLNIQHDANHGSISRNPMVNRLFGYSQDWIGGSRMLWIRQHVGHHTHCNRHQHDPDIKGGSV
ITLSPYSLPKEFHHIQQYFLPLDQLYGFQWVFLGLHDLIDWKYKGEKLPESYRPDFNIAIGLRVFFARFFAVPFALHFSWYTLLCTYLWVAIAALYLGFFFILSHIFIGIK
SLPEDAKNIDWARHQIESSSNVCGEKLGHSNGGLNYQIEHHLFPRMSHAHYSKIQPVVQKVCEENGVNYKKFPTILSNLDSLFRQVKGLGSVATEFMEGL >SEQ-101 - 91% sequence identity to SEQ ID NO 79
MPPHSRTKGSDPELSDLMKHFTREEILGHTNPDYCILGDGVYDLTNFRDEHPGGDVLDFFPGQDATPHFFQFHQREWLPSVLAEYFVGSVARDDSYVQHTSLMKQIKSAVRKV
MPMGEWWAPPSWYIKACAILVATLYTDYLMIASGPTIPLAIVIGLLYAAIGLNIQHDANHGSVSRNPMVNRLFGYSQDWIGGSRMLWIRQHVVGHHTHCNRIQHDPDVKGGSV
LTLSRYSLPKEFHHIQQYFLPLIQLLGFQWIFLGLHDLIEMKYKGEKLPESYRKEYNIAIGLRVFFFARKVVVPFALHFSWYTLLCIYAWMASASLYLGFFFILSHLFVGAK
SLPEDANIDWARHQIESSSNVGGEKLGHSNGGLNYQIEHHLFPRMSHAHYSKIQPVVQKICEENGVNYKHFGTILSNLDSTFRQVKALGSVAVYEFMEKP >SEQ-102 - 91% sequence identity to SEQ ID NO 79
MPPHSRRKVSDPELSDLMKHFTRERILNHTRDKYCILEDGVYDLTNFRDKHPGGDVLDFFPGQDATPHFYQYHQHESLPSVLARYKVGSVERDDSYVYHDPLMLQIKSAVRKV
IPMQEWWAPPSWYIKACAILIATLFTDYLMIASGPTIPLAIVSGLLYAWIGLNIQHDANHGSVSRNPMVNRLFGYSQDWIGGNRMLWIRQHVVGHHTHCNRVQHDPDVKGGSV
ITLSPYSLMKEFHHLQQYFLPLEQLIEMKWKGEKLPESYRKERNIAIGLRVFFEFIRKFVVPFALQFSWYTLLCTYLWMATAALYLGFFFILSHIFIGVK
SIPEDANIDWARHQIESSSNVCGEKLGIMNGGLNYQIEHHLFPRMSHAHYSKIQPVVQKVCEEDGVNYKHFGTILSNLGSTFKQVGALGSVAVEFMEGL >SEQ-103 - 91% sequence identity to SEQ ID NO 79
MPPHSRTKVSDPELSAMKHFTREEILNHTNDKYCILEDGVYDLTNFRDKHPGGDVLDFFPGQDATPHFYMLHQKESLPAVLAEYKVGSVARDDSYVYHDALHKQIKSAVRKVM
PMQEWWAPPSWYIKACAIIVATLYTDYLMIASGPTILLAIVSGLLFAWIGLNIQHDANHGSVSRNPMVNRLFGYSQDWIGGSRMLWIRQHVGHHTHCNRHQHDPDVKGGSVI
TLSRYSLPKEFHHIQQLYFLPLEQLIGFQWVFLGLHDLIEWKYKGEKLSESYRKERGIAIGLKVGFWIRFFVVPFALHFTWYTLLCTYLMVCIAALYLGFFFILSHIFVGVKS
LGEDANIDWARHQIESSSNVCGEKLGIINGGLNYQIEHHLFPRMSHAHYSKIQPVVQKVCEENGVNYKHFGTILSNLDSTFKQVGGLGSVPVYEFMEGL >SEQ-104 - 91% sequence identity to SEQ ID NO 79
MPPHSRTKVSDDPELSDLMKHFTYEEILNDTRDKYCILGDGVYDSTNFRDKHPGGDVLDFFPGQDATPHFYMYHQREWLPSVLSEFKVGSLARDDSVYVHTPLMKQIKSAVRK
VMPMQEWWAPPSWIKACAILVATLYTDYLWIARGPTIPLAIVSGLLYAAIGLNIQHDANHGVSRNPVVNRLFGYSQDWIGGSRMLWIRQHVGHHTHTNRHQHDPDVKGGS
VITLSPTSLPMEFHHIQQIYFLPLEALLGFQWVFLDLHDLLEMKYKGEKLPESYRKERNIAIGLRVFFIRKVVLPFALHFSWYTLLCTCLWMAIAAFYLGFFFILSHNFVGA
KSLPEDANVDWARHQIESSSNVGGEKLGISNGGLNYQIEHHLFPRMSHAHYSKIQPVVQKVCEENGVKKFGTILSNLDSTFRHVGALGSVAVYEFMEKL

Figure 3 (continued)

>SEQ-105 - 91% sequence identity to SEQ ID NO 79
MPPHARRKVSDPELSAAKHFTRERILNHTRDKYCILEDGVYDLTNFRDEHPGGDVLDIFPGQDATPHFYMLHRYESPPSVLAEYKVGSVARDDSFTYHTPLMKRIKSAVRAVM
PMQEWWAPPSWYIKACAILVATLYLDYLWIAKGPTIPLAIVIGLLFAAIGLNIQHDANHGSVSRNPMVNRLFGYSQDWIGGSMMLWIQQHVVGHHTCNRHQHDPDVKGGSVI
TLSRYSGPKEFHHIQQIYFLPLIQLLGFQWVFLGLHDLIEMKYKGEKLPPSYRKERNIAIGCRVFFIRKFVVPFALHFSWYTLLCTCLWMAIAALYLAFFILSHIFVGAKS
LPEDAKNIEWARHQIESSSNVCGEKLGHSNGGLNYQIEHHLFPRLSHSHYSKIQPVVQKVCEENGVNYKKFPTIGSNLDSTFRHVKALGSVAVYEFMEGL >SEQ-106 - 90.8% sequence identity to SEQ ID NO 79
MPPHSRTKVSAPELSDMKHFTREEIANHTNDKLCILEDGVYDLTNFRDKHPGGDFLDFFPGQDATPHFYMLHQREWLPSVLAEYKVGSVARDDSYVQHDPLMKRIKSAVRKVI
PMQEWWAPPSWYIKACAILATLYTDYLWIASGPTIPLAIVSGLLFAAIGLNIQHDANHGSVSRNPMVNYLFGYGQDWIGGSRMLWIRQHVVGHHTCNRVQHDPDVKGGSVI
RLSRYSLPMEFHHIQQYFLPLEQLLGFQWVFLGLHDLIEMKYKGEKLPESYRKEFNIAIGLRVGFFARKFVVPFALHPSWYTLLCTCLWMAIAAFYLAFFFILSHIFVGAKS
LPPDANIDWARHQIETSSNVCGDWLGHSNGGLNYQIEHHLFPRMSHAHYSKIQPIVQKVCEENGVNYKHFGTILSNLDSIFRQVKALGSVATYEFMEGL >SEQ-107 - 90.8% sequence identity to SEQ ID NO 79
MPPHSRTKVSDPELSALMKHFTREEILGDNNDKYCILEDGVYDLTNFRDKHPGGEVLDFFPGQDATPGFYMLHQYASLPAVLAEYGVGSVARDDSYVHHTPLMKQICSDVRKV
MPMGEGWAPPSWYIKACAILAATLYTDYLWIARGPTIPLAIVIGLLFAAIGLNIQHDANHGSVSRNPMVNRLFGYSQDWIGGSRMLWIRQHVVGHHLHCNRHQHDPDVKGGSV
ITLSRYSLWLEFHHIQQYFLPLIQLLGFQWVFLGLHDLIEWKYKGEKLPESARPERNIAIGLRVFFARKIIVPFALHFSWYTLLCTCLWMATAALYLGFFFILSHIFVGAK
SLPEDANIDWARHQIESSSNVGGEKLGILNGGLNYQIEHHLFPRMSHAHYSKIQPVVQKVCEENGVNYKHFGTIASNLDSTFSQVGALGSVAVEFMEGL >SEQ-108 - 90.8% sequence identity to SEQ ID NO 79
MPPHSRSKVSDPELKDLMKHFTREEKLNHTNDKYCILEDGVYDLTNFRDKHPGGDVLDLFPGQDATPGFYMLHRYEWLPSVLAEYKVGSVARDDSYVYHTPGYKQIKSAVNKV
MPMQEWWAPPSWYIKACAILAATLYTDYLWIAKGPTIPLAIVIGLNIQHDANHGSVSRNPMVNRLFGYSQDWIGGSRMLWIRQHVVGHHTCNDIQHDPDVKGGGA
ITLSRVSIPKEFHHIQQYFLPLDQLLGFQWVFLGLHDLIEWKWKGEKLPPSYRKERNPAIGCRVFFFIRKFVPLAHFSWYTLLCTYLWMAIGALYLGFFFILSHIFVGAG
SLPEDANIDWGRHQIESSSNVCGEKLGISNGGLNYQIEHHLFPRMSHAHYSKIQPVVQKICEENGVNYKHFGTILSNLDSTFSQVKALGSVPVEFMEGL >SEQ-109 - 90.8% sequence identity to SEQ ID NO 79
MPPHSRTKVSVPELSDLAKHFTREEILNHTNDKYCILEDGVYDLTNFRDKHPGGDVLDFFPGQDATPHFYMLHRYEWPPSVLAEYKVGSVARDDSYVYHTPLMKQIKSAVRKV
IPMGEGWAPPSWYIKACAILAATLYTDYYWIAKGPTIPLAIVSGLLYAAIGLNIQHDANHGSISRNPMVNYLFGYSQDWIGGSRMLWIQQHVVGHHTCNEIDHDPDVKGGSV
ITLKRSSLPKEWHHIQQYFLPLPEQLLGFQWVFLGLHDLIEWKYKGEKLPEIYRKERNIAIGCRVFFARKFAVPFALHFSWYTLLCTYLWMAIGALYLGFFFILSHIFVGAK
SLGPEANIEWARHQIESSSNVCGEKLGIGILNGGLNYQIEHHLFPRMSHAHYSKIAPVVQRVCEENGVNYKHFGTILSNLDSTFRQVKAIGSVAVEFMEGL >SEQ-110 - 90.8% sequence identity to SEQ ID NO 79
MPPHSRTKVSDPELSDLMKHFTREKILNHTNDKYCILEDGVYDLTNFRDKHPGGDFLDFFPGQDATPHFYMLHQYEWLPSVLAEYKVGSVARDDSYVYHDPLHLQICCAVRKV
MPMQEWWAPPSWWIKACAILIATLYTDYLWIASGPTIPLAIISGLLYAAIGLNIQHDANHGSVSRNPMVNYLFGYSQDWIGGSRMLWIRQHVVGHHTHSNRHQHDPDVKGGSV
ITLSRYSLPMEFHHIQQYFLPLDALYGFQWVFLGLHDLIEMKWKGEPLPELYRKERNIAIGLKVFFIRKFVVPFALHFSWYTLLCTCAWMAIAALYLAFFILSHNFVGIK
SLPEDASIDWARHQIESSSNVGGEKLGILNGGLNYQIEHHLFPRMSHAHYSKIEPVVQKVCEENGVNYKKFGTIGSNLGATFRYVKALGSVPTYNEFMEGL

Figure 3 (continued)

>SEQ-111 - 90.8% sequence identity to SEQ ID NO 79
MPPHSRTKGSDDPELSDMKHFTYEEILNHTNPKYCILEDGVYDLNNFRDKHPGGDFLDFFPGQDATPHFYMFHQHVSLPSVLAEYKVGSIARDDSYVYHDPLMKQIKSAVRGV
MPMQEWWAPPSWYIKACAILAATLYTDYWLASGPTIPLGIVSGLLYAAIGLNIQHDANHGSLSRNPMVNRLFGYSQDWIGGNRMLWIRQHVVGHHTCNRIDHDPDVKGGGV
ITLSRSSLPKEFHHIQQYFLPLPEQLYGFQWVFLGLHDLLEMKYKGEKLPESARKERNIAIGLRVFFFIRKFVVPFWLHFSWYTLLCTYLWMATAAFYLCFFFILSHIFVGVK
SLPEDAKNIDWARHQIESSSNVCGEKLGISNGGLNYQIEHHLFPRMHHAHYSKIAPVVQKVCEEMGVNYKKFGTILSNLDSTFRQIKALGSVAVYEMEGL >SEQ-112 - 90.8% sequence identity to SEQ ID NO 79
MPPHSRTKVSDDPELSDMKHFSREEILDHTRDKYCILEDGVYDLNNFRDKHPGGDVLDFFPGQDATPGFYMLHQRESLPGVLAEYFVGSIARDDSFVHHEPLMKQICSAVRGV
LPMQEWWAPPSWYIKACAILAATLYTDYLWIASGPTIPLSIVIGLLYAAIGLNIQHDANHGSVSRNPMVNRLFGYSQDWIGGSRVLWIQKHVVGHHTCNRVDHDPDVKGGSV
ITLSPSSLPKEFHHIQQYFLPLPDLQLLGFQWVFLGLHDLIEMRYKGEKLPESYRKEFNIAIGLRVFFFIRKFVVPFFALHFSWYTLLCTYLWMAIAALYLGFFFILSHIFVGVK
SLPEDAKNIDWARHQIESSSNVCGEWLGHSNGGLNYQIEHHLFPRMNHAHYSKIQPVVQKVCEENGVNYKKFPTIGSNLDSIFRQVKALGAVAVYEFMEGP >SEQ-113 - 90.8% sequence identity to SEQ ID NO 79
MPPHSRRKVSDSDPELRDLMKHFTREEILNHTDKYCILEDGVYDLTNFRDKHPGGDYLDFFPGQDYLDFFPGQDATPHFYMYHQVSLPSLLAEYKVGSVARDDSYVYHTPLMKQIKADVR
KVMPMGEWWAPPSWYIKACALIVATLHTDYLWIASGPTIPLAIVIGLLYAAIGLNIQHDANHGSVSRNPMVNRLFGYSQDWIGGSRMLWIRQHVVGHHTCNRHQHDPDVKGG
SVIQLSPTSLPLEFHAIQQYYFLPGIQLLGFKWVFLGLHDLIEMKYKGEKLSESYRKDRNIAIGLRVFFWSWYTLLCIYLWMAIGALYLGFFFILSHIFVG
AKSLPPDAKNIDWARHQIESSSNVCGDKLGISNGGLNYQIEHHLFPRLSHAHYAPIQPVRKVCEENGVNYKKFGTIGSNLDSTFQYVKALGSVAVYEFMEGL >SEQ-114 - 90.6% sequence identity to SEQ ID NO 79
MPPHSRTKVSDPELSDMEHFARERILNHTNDKYCILEDGVYDLTNFRDKHPGGDYLDIFPGQDATPHFYMLHQYEWPPSVLARYKVGSLARDDSYVQHTPLMKQICSAVRKVM
PMQEWWAPPSWYIKACAILAATLYTDYWIASGPTIPLGIVSGLLYAAIGLNIQHDANHGSVSRNPMVNRLFGYSQDWIGGSRLLWIRQHVVGHHTCNDHQHDPDVKGGSVL
TLSRVSLPKEFHHIQQYFLPLIVLYGFQWVFLDLHDLIEMRYKGEKLPESYRPERNIAIGCRIFFFEARKFAVPFALHFSWYTLLCTYLWVAIASLYLGFFFILSHNFVGAKS
LPEDANIDWARHQIENSSNVCGEKLGILNGGLNYQIEHHLFPRMHHAHYSKIQPVVQKVCEENGVNYKHFGTILSNLDSIFRQVKALGSVAVEFMEGL >SEQ-115 - 90.6% sequence identity to SEQ ID NO 79
MPPHSRTKVGDPELKDMKHFTYERILNHTRDKYCILEDGVYDSTNFRDKHPGGDVLDFFPGQDATPHFYMLHKYEWPPSILAEYKVGSVARDDSYVQATPLMLQIKSAVRKVM
PMQEWWAPPSWYIKACAILAATLYTDYLWIARGPTILLAIVSGLLYAWIGLNIQHDANHGAVSRNPMVNRLFGYSQDWIGGSRMLWIRQHVVGHHTHTNRHQHDPDVKGGSVI
TLSRYDLPKEFHHIQQYFLPGEQLLGFQWVFLGLHELIEMKWKGEKLPESYRPERNPAIGLKVGFWIRKVVIPFALHFSWYTLLCTYLWMAIAALYLGFFFILSHIFVGVKS
LPEDANIDWARHQIESSSNVCGEKLGIMNGGLNYQIEHHLFPRMSHAHYSKIQPVVQKVCEENGVNYKKFGTILSNLDATFRQIKALGSVAVYEMEGL >SEQ-116 - 90.6% sequence identity to SEQ ID NO 79
MPPHSRKKVVSDPELSDLMKHFSYERILNHTNDDYCILGDGVYDLTNFRDKHPGGDYLDFFPGQDATPHFWMLHQKESPPSVLAEYKVGSVARDDSYVYYDPLMKQIKSAVRK
VMPMQEGWAPPSWYIKACAILAATLYTDYLWLASGPTIPLSIVSGLLYAWIGLNIQHDANHGSLSRNPMVNRLFGYGQDWIGGSRMLWIRQHVVGHHTHSNRHQHDPDLKGGS
VIRLSRTSLPLEFHNIQQYYFLPLDQLLGFVWFLGLNDLIEMRYKGEPLPESYRKERNIAIGLKIFFFVRKFVVPFALHFSWYTLLCTCAWMAIAALYLGFFFILSHIFVGA
KSLPEDANIDWARHQIESSSNVCGEKLGHSNGGLNYQIEHHLFPRMSHAHYSKIQPVVQRVCEENGVNYKKFGTILSNLDSTFSQVKALGAVAVYEFMGGL

Figure 3 (continued)

>SEQ-117 - 90.6% sequence identity to SEQ ID NO 79
MPPHSRTKVSDDPELSDAKHFTREEILGHTNDKYCILEDGVYDCTNFRDKHPGGDVLDIFGGQDATPHFYMLHQYESPPSVLAKYKVGSVERDDSYVYHEPLMKQIKSAVRKV
IPMQEGWAPPSSWWIKACALLAATLYTDYLMIARGPTIPLAIVSGLLYAAIGLNIQHDANHGSVSRNPMVNRLFGYSQDWIGGSMMLWIRQHVVNHHTHCNRIDHDPDVKGGSV
ITLSRYSLPKEFHAIQQYFLPLEQLIGFKWIFLGAHDLIEMKYKGEKIPESYRKERNIAIGLRVFFFIRKIVVPFALHPSWYTLLCTYLMWCIAALYLAFFFILSHIFVGAK
SLPPDANIDWARHQIENSSNVCGEWLGYLNGGLNYQIEHHLFPRMSHAHYSKIQPVVQKVCEENGVNYKKFGTILSNLDSTFRQVKALGAVPVEFMEGL >SEQ-118 - 90.6% sequence identity to SEQ ID NO 79
MPPHSRRKVSDPELRDLKAKHFTYTEILNHTNDDLCILEDGVYDLTNFRDKHPGGDVIDIFPGQDATPGFYMLHKYESLPSVLAEFKVGSVARDDSYVYHTPLMLQIKSAVRK
VLPMGEWWAPPSSWYIKACAILAATLYLDYYWIARGPTILLAIVLGLLYAAIGLNIQHDANHGSVSRNPMVNRLFGYAQDWIGGSRMLWIQQHVVGHHTHCNDHQHDPDVKGGS
VITLSRYSLPLEFHHIQQYFLPLEQLLGFQWVFLGAHDLIEMKYEGEKLPESYRKERNIAIGCRVFFEIRKFVVPFALHFSWYTLLCTYAWVAIAAFYLGFFFILSHIFIGA
KSLPEDAKNIDWVRHQIESSSNVCGEKLGHSNGGLNYQIEHHLFPRMSHAHYSKIQPVVQKVCEEMGINYKKFGTIGSNLDSTLRQVKALGSVAVYEFMEGL >SEQ-119 - 90.3% sequence identity to SEQ ID NO 79
MPPHSRTEVSDPELKAMKHFTREEILNHTNDDICILEDGVYDLTNFRDKHPGGDYLDFFPGRDATPHFYMLHQYESLPSVLAEYKVGSIARDDSYVYHTPGMKQICAEVRKVM
PMGEWWAPPSSWYIKACAIIAATLFLDYLWIASGPTIFLAIVSGLLYAAIGLNIQHDANHGSVSRNPMVNRLFGYSQDWIGGSRMLWIRQHVVGHHTHTNRHQHDPDVKGGSVI
TLSRYSLWKEFHHIQQYFLPLDQLLGFQWVFLGLHDLIEMKYKGEKIPESARPEYNPAIGLRVFFEIRKFVVPFWLHFSWYTLLCTCLWMAIAAFYLGFFFILSHNFVGAKS
LPPDANIDWARHQIETSSNVCGEKLGISNGGLNYQIEHHLFPRMHHAHYSKIQPVVQKICEENGVNYKHFGTIGSNLDSTLQQVKALGSVPVYEFMEGL >SEQ-120 - 90.3% sequence identity to SEQ ID NO 79
MPPHSRTKVSDDPELRDMKHFTREEILNHTNDDYCILGDVYDLTNFRDKHPGGDVLSFFPGQDATPHFYMLHQYESLPSVLAEYKVGSIARDDSYVYAEPLQKQIKSAVRKV
LPMGEWWAPPSSWYIKACAILAATLFLPLIVLLGFQWVFLGLHDLIEMKYKGEKLPPSYRKEYNPAIGLRVFFWIRKFVPFWLHFSWYTLLCTCLWMAIAAFYLGFFFILSHIFVGAK
IQLSPYDLWMPFHHIQQIYFLPLIQLYGFQWVFLGLHDLISNGGLNYQIEHHLFPRMSHAYSKIQPVVQKVCEENGVNYKKFPTIGSNLDSIFRQVKALASVAVEFMEGL
SLPEDASIDWARHQIESSSNVGGEKLGHSNGGLNYQIEHHLFPRMSHAHYSKIQPVVQKVCEENGVNYKKFPTIGSNLDSIFRQVKALASVAVEFMEGL >SEQ-121 - 90.3% sequence identity to SEQ ID NO 79
MPPHSRTKVSDDPELKDMKHFTREEILNHTNDKYCILGDGVYDLTNFRDEHPGGDVLDFFPGQDATPHFYQLHRYEWPPSVLSEYKVGSVARDDSYVHHTPLHKQLKSAVRKVL
PMGEWWAPPSSWYIKACAIIIATLYTDYLWIASGPTIFLAIVSGLLFAWIGLNIQHDANHGSVSRNPMVNRLFGYSQDWIGGSRMLWIRQHVVGHHTHCNRHDHDPDVKGGGVI
RLSRYSLPMPFHHIQQIYFLPLIQLYGFQWVFLGLHDLIEMKYKGEKIPESYRKLYNIAVGLKVFFFIRKFVVPFALHFSWYTLLCTYLWMAIAALYLGFFFILSHLFVGAKS
LPEDANIEWARHQIESSSNVCGEWLGISNGGLNYQIEHHLFPRMSHAHYSKIQPVVQKVCEENGVNYKKFGTILSNLGSTFRQVKALGSVAVEFMEGI >SEQ-122 - 90.3% sequence identity to SEQ ID NO 79
MPPHSRTKVSDPELSDLMKHFSRTRILNHTNDKYCILEDGVYDLTNFRDKHPGGDVLDLFPGQDATPHFYELHQYEWLPAVLAEYGVGSIARDDSYVYHDPIMLRLKCEVNGV
MPRGEGWAPPSSWYIKACAILAATLYTDYLMIASGPTIPLAIVSGLLYAAIGLNIQHDANHGSVSRNPMVNRLFGYSQDWIGGSRMLWIRQHVVGHHIHSNRHDHDPDVKGGGV
IRLSRYSLPKEFHHIQQIYFLPLIQLYGFQWVFLGLHDLIEMKYKGEKLPESYRKERNIAIGLRVFFFIRKFILPFALHFSWYTLLCTCLWVAIAALYLGFFFILSHIFVGAK
SLPEDAKNIDWARHQIESSSNVCGEKLGISNGGLNYQIEHHLFPRMHHAHYAKIQPVVQKVCEENGINYKKFGTILSNLGSTFQQVKAIGSVAVYEFMEGP

Figure 3 (continued)

>SEQ-123 - 90.1% sequence identity to SEQ ID NO 79
MPPHSRTKVSAPELSDLMKHFTREKILNHTNDKICILEDGVYDATNFRDKHPGGDYLDFFPGQDATPHFYMYHQYESPPSVLAEFFKVGSVARDDSYTHDPLYKRIKSDVRKV
LPMQEWWAPPSWYIKACAILAAALYLDYLMIASGPTIPLAIVSGLLYAAIGLNIQHDANHGSVSRNPMVNRLFGYSQDWIGGSRLLWIRQHVVGHHTCNRVQHDPDVKGGSV
ITLSRYSLWKEFHHIQQYYFLPLIQLYGFQWVFLGLHDLIDWKYKGEKLPESCRKERAIAIGLRVGFFARKFVLPLWLHFSWYTLLCTCLWMAVAALYLGFFFILSHIFVGAK
SLPEDANIDWARHQIESSSNVGGEKLGISNGGLNYQIEHHLFPRMSHSHYSPIAPVVQKVCEENGVNYKHFGTILSNLDSTFRQIKALGSVAVEFMEGL >SEQ-124 - 90.1% sequence identity to SEQ ID NO 79
MPPHSATKVSVPELSDLAKHFTREEILNHTNDKYCILEDGVYDLTNFRDKHPGGDVIDFFPGQDATPHFWMFHQKESPPSVLSEYKVGSVARDDSYTHHDPLMKQIKSAVRKV
IPRQEWWAPPSWWIKACAILAATLHTDYLWIASGPTIPLAIVSGLLYAWIGLNIQHDANHGSVSRNPMVNRLFGYSQDWIGGSRMLWIRQHVVGHHTHCNDHQHDPDVKGGSV
ITLSPYSLPKEFHAIQQYYFLPLDQLYGFQWVFLGAHDLIEMKYKGEPLPESYRKEYNIAIGLRVFFEIRKEYNIAIGLRVFFEIRKFVLPFALHPTWYTLLCIYLWMAIAAFYLGFFFILSHIFVGAK
SLPPDAKNIDWARHQIESSSNVCGEWLGISNGGLNYQIEHHLFPRMNHAHYSKIEPVVQKVCEENGVNYKHFGTIGSNLDSTFRQVKALGAVPVEFMEGL >SEQ-125 - 90.1% sequence identity to SEQ ID NO 79
MPPHSRTEVSDDPELSDMKHFTREEILNHTNDKLCILEDGVYDATNFRDKHPGGDFLDFFPGQDATPHFYMYHQYESPPSVLAKYKVGSVDRDDSYVYHTPLMKQIKSAVRKI
MPRQEWWAPPSWWIKACAILVATLYTDYLWIASGPTILLGIVSGLLYAAIGLNIQHDANHGSVSRNPVVNRLFGYSQDWIGGSRMLWIRQHVVGHHTHTNDIQHDHDPDVKGGSV
IRLSRYSIWKPFHHIQQYYFLPLDQLYGFQWVFLGLHDLIEMKYKGEKLPESYRPLRNIAIGLRVFFEVRKFVLPFALHFSWYTLLCIYLWMAIAALYLGFFFILSHIFVGAK
SLPEDGNIDWVRHQIESSSNVGGEKLGISNGGLNYQIEHHLFPRMSHAHYSKIQPVVQKVCEEDGVKYKKFGTIASNLDSTLSQVKALGSVAVEFMEGL >SEQ-126 - 90.1% sequence identity to SEQ ID NO 79
MPPHSRTKGGDPELSDMKHFTREKILNHTNDKYCIVEDGVYDLTNFRDKHPGGDVLDFFGGQDATPHFFMLHQRESPPSSLLAEYKVGSVARDDSYVYHTPLMKQICSAVNGVM
PMGEGWAPPSWYIKACAILAATLALDWLMIASGPTIPLAIVSGLLYAAIGLNIQHDANHGAVSRNPAVNRLFGYSQDWIGGSRMLWIRQHVVGHHTHCNDHQHDPVKGGSAI
TLSRTDLPKEFHHIQQYYFLPLEQLLGFQWVFLGLHDLIEMKYKGEPLPESYRKLRNIAVGCRIFFFARKFAVPFALHFSWYTLLCTCLWMAIAALYLGFFFILSHIFVGAKS
LPPDANIDWARHQIESSSNVCGEKLGISNGGLNYQIEHHLFPRMSHAHYSKIQPVVRKVCEENGINYKKFGTILSNLDSTFRQLKAIGSVPVYEFMEGL >SEQ-127 - 90.1% sequence identity to SEQ ID NO 79
MPPHSAKKGSDVPELRDLMKHFTRTEILNHTNDKLCILGDGVYDLTNFRDKHPGGDVYDLTNFRDKHPGGDVDLNIQHDANHGGVSRNPMVNYLFGYSQDWIGGSRMLWIRQHVGHHTHCNRHQHDPDVKGGG
VMPMQEWWAPPSWYIKACAILAATLYLDYLWIASGPTIPLAIVSGLLYAAIGLNIQHDANHGGVSRNPMVNYLFGYSQDWIGGSRMLWIRQHVGHHTHCNRHQHDPDVKGGG
VITLSPYSLPKEFHHIQQYYFLPLEQLLGFKWVFLGLHDLIEMKYKGEKLPESYRKERNIAVGLRVFFFIRKFVIPFALHFSWHTLLCIYLWMAIGALYLGFFFVLSHIFVGV
GSLGEDANVDWARHQIETSSNVCGEKLGIMNGGLNYQIEHHLFPRMSHAHYSPIQPVVQKVCEENGVKYKKFGTILSNLDSTFSQVKALGSVATEFMGKI >SEQ-128 - 89.9% sequence identity to SEQ ID NO 79
MPPHSRTKVGDPELSDMKHFTREEILDHTNDKLCILEDGVYDATAFRDKHPGGDVLDFFPGQDATPHFYMYHQESPPSVLAEYKVGSLARDDSYVYHTAGMKQIKSAVRGII
PMQEWWAPPSWYIKACAILAATLYTDYLWIASGPTIPLAIVSGLLYAAIGLNIQHDANHGSVSRNPAVNRLFGYSQDWIGGSMMLWIRQHVVGHHTNRIDHDPDVKGGSVI
QLSPSSLPKPWHHIQQYYFLPLIQLLGFQWVFLGLHDLIEWKYKGEKLPESCRKERNIAGCRIFFFARKFAVPFWLHFSWYTLLCTYLWMAIAALYLGFFFILSHIFIGAGS
LPEDANIDWARHQIESSSNVCGEKLGIINGGLNYQIEHHLFPRMSHAHYSKIQPVVQKVCEENGVNYKHFGTILSNLDSTFRQVKALGSVPVEFMEGP

Figure 3 (continued)

>SEQ-129 - 89.9% sequence identity to SEQ ID NO 79
MPPHSRTKVSDVPELSDLMKHFTREEILNHNNDKICILGDGVYDLTNFRDKHPGGDVLDFFPGQDATPHFYMYHQYESPPSVLAEYKVGSVARDDKYVQHTPLMKQIKADVRK
VMPMGEWWAPPSWYIKACAILIATLYTDYLWIARGPTIPLAIVSGLLYAAIGLNIQHDANHGSLSRNPMVNRLFGYAQDWIGGSRMLWIRQHVVGHHLHCNRIDHDPDVKGGS
VIKLSPYDGPKEWHHIQQIYFLPLIQLYGFQWVFLGLHDLIEWRYKGEKLPESYRKEFNIAIGLRVFFFIRFFVLPFALHFSWHTLLCTYLMAIGALYLAFFFILSHIFVGA
KSLPPDANIDWARHQIESSSNVCGEWLGISNGGLNYQIEHHLFPRMHHAHYSPIQPVVQRVCEENGVNYKKFGTIASNLDSTFRQVKALGSVAVEFMEGL >SEQ-130 - 89.7% sequence identity to SEQ ID NO 79
MPPHSRTKVSDDAELSDMKHFTREEILDHTNDKYCILEDGVYDCTNFRDKHPGGDVIDFFPGQDATPHFYMLHQKAWPPSVLAEYFVGSVARDDSYVQHEPLHKQICSAVRKV
MPMQEWWAPPSWYIKACAILAATLYTDYLWIASGPTIPLSIVSGLLYAAIGLNIQHDANHGSVSRNPMVNLFGYGQDWIGGSRVLMIRQHVGHHTHTNDHDHDPDVKGGSV
ITLSRSSGPKEWHHIQQYFLPGIQLYGFKWVFLGLHDLIEWKYKGEKLPEIYRKERNIAIGLRVFFIRKFWVPFALHFSWYTLLCTYAWMATGAFYLGFFFILSHIFIGAK
SLPEDANIDWARHQIESSSNVCGEKLGYSNGGLNYQIEHHLFPRMSHAHYSKIQPVVRKVCEDNGVNYKHFGTILSNLGSTFRQVKALGSVAVEFMEGP >SEQ-131 - 89.7% sequence identity to SEQ ID NO 79
MPPHARTKGSDPELKDMKHFTREEILNHNNDKYCILGDGVYDLTNFRDKHPGGDYLDFFGGQDATPHFYEYHQHESPPSVLAEYKVGSVARDDSYVQHTELMKQIKSAVRGVL
PMQEWWAPPSWYIKACALIVATLYLDYLWIASGPTIFLAIVSGLLYAAIGLNIQHDANHGSVSRNPVVNRLFGYSQDWIGGSRMLWIQKHVVGHHLHCNRHQHDPDVKGGSVI
TLSPYSGWKEFHHLQQIYFLPLIQLLGFQWVFLGLHDLIEMKYKGEKLPEIYRKLRNIAIGCRVFFEIRKFVVPFWLHFSWYTLLCTYLMASAALYLGFFFILSHIFVGAKS
LPEDANIDWARRQIESSSNVCGEKLGHSNGGLNYQIEHHLFPRMSHAHYAKIQPVVQKVCEENGVNYKHFGTILSNLDSTFRQVKALGSVAVYEFLEGL >SEQ-132 - 89.7% sequence identity to SEQ ID NO 79
MPPHGRTEGSDPELRDMKHFTRERILDHTNDKLCILEDGVYDLNNFRDKHPGGDFLDFFPGQDATPHFFQLHQYESLPSVLAEYKVGSVARDDSYVYHDPLMKQLKSAVRAVM
PKQEGWAPPSWYIKACAILAATLYLDYLWIASGPTIPLAIVSGLLYAAIGLNIQHDANHGSISRNPMVNLFGYSQDWIGGSRMLWIRQHVVGHHTHCNRHQHDPDVKGGSVI
TLSPYSLPKEWHHIQQYFLPLDQLLGFQWVFLGLHDLIDMRYKGEKLPPIYRKERAPAIGLRVFFEIRKFVVPFWLHPSWYTLLCTCAWVAIAAFYLGFFFILSHIFVGIKS
LPEDAKNIDWARHQIESSSNVCGDKLGYSNGGLNYQIEHHLFPRMSHAYYSKIQPVVQKVCEENGVNYKKFGTILSNLDSTFRQVKALGSVPVEFMEGL >SEQ-133 - 89.7% sequence identity to SEQ ID NO 79
MPPHSRTKVSDPELRDLMKHFTREEILNHTNDDYCILGDGVYDLTNFRDEHPGDFLDFFPGQDATPHFYMLHQRESLPSVLAEYKVGSVDRDDSYVQHEPLMKQIKSAVRKI
MPKQEWWAPPSWWIKACAILAAALYTDYLWILLSGPTIPLAIVSGLLYAWIGLNIQHDANHGSIRQHVVGHHIHCNRHDHDPDLKGGSA
IQLSRVSLPKEFHHIQQYFLPLPEQLYGFQWVFLGLHDLIDMKWKGEKLPESYRPEYNIAIGLRVGFFIRKFVVPLALHFSWYTLLCTYLMWAIAALYLCFFFILSHIFVGIK
SLPEDAKNIDWARHQIESSSNVGGEKLGHINGGLNYQIEHHLFPRMSHAHYAKIQPVVQKVCEENGVNYKHFGTIASNLDALFRQVKALGSVPVYEFMEGL >SEQ-134 - 89.7% sequence identity to SEQ ID NO 79
MPPHSRTKVGDPELRAMEHFTRERILNHTNDKYCILNHTDYLWIASGPTIPLAIVLGLLYAAIGLNIQHDANHGSIPVLAEYFVGSVARDDSYVYTPLHKQIKSAVRGVM
PMQSWWAPPSWYIKACAILAATLHTDYLWIASGPTIFLAIVLGLLYAAIGLNIQHDANHGSVSRNPMVNRLFGYSQDWIGGSRMLWIRQHVVGHHIHTNRHQHDPDVKGGSVI
RLSRYSLWKEFHHIQQYFLPLPEQLYGFQWIFLGLHDLIEMKYKGEKLPELYRKEFNIAIGLRVFFFARKFVVPFALHFSWYTLLCFFFILSHIFVGVKS
IPEDANIDWARHQIESSSNVCGEWLGISNGGLNYQIEHHLFPRMSHAHYSKIEPVVQKVCEENGVKYKKFPTILSNLDSTFRQIGALGSVAVEYMEKL

Figure 3 (continued)

>SEQ-135 - 89.7% sequence identity to SEQ ID NO 79
MPPHGRTKVSDDPELSDMKHFTREEILNHTNDKYCILEDGVYDLTNFRDEHPGGDVLDFFPGQDATPHFWMYHRYASPPSVLAEYKVGSVDRDDSYVYHEPLMKQLKADVRKV
MPMQEGWAPPSWWIKACAILAATLHLDYLMIAKGPTIPLAIVSGLLYAAIGLNIQHDANHGSVSRNPMVNRLFGYSQDWIGGSRMLWIREHVVGHHTHCNRHQHDPDVKGGSV
ITLSPYSLPLPFHHIQQYYFLPLEQLYGFQWVFLGLHDLIEMKYKGEPLPESYRKERNIAIGLRVFFVRKIVVPFALHFSWYTLLCTYLWMASAAFYLAFFILSHIFVGVK
SLGEDANIDWARRQIESSSNVCGEKLGISNGGLNYQIEHHLFPRMSHAHYSKIQPVVQKVCEEDGVNYKKFPTILSNLDATFRHVGALGSVAVEFMEKL >SEQ-136 - 89.7% sequence identity to SEQ ID NO 79
MPPHSRRKVSDPELSDAKHFTYTEKLNHTNPKYCILEDGVYDLSNFRDKHPGGDVLDFFPGQDATPHFYMYHQYESPPSVMAEYKVGSVARDDSYVYATELMLQIKSAVRKVM
PMQEWWAPPSWYIKACAIIAATLYTDYLWIASGPTIPLAIVLGLLYAWIGLNIQHDLLYAWIGLNIQHDLIEMKYKGEPLPPLYRKEFAIAIGLRVGFWIRKFVVPFALHFSWYTLLCIYLWMASAAFYLGFFILSHIFVGAKS
TLSRTSLPKEFHHIQQLYFLPLIQLYGFQWVFLDLHDLIEMKYKGEPLPPLYRKEFAIAIGLRVGFWIRKFVVPFALHFSWYTLLCIYLWMASAAFYLGFFILSHIFVGAKS
LPEDAKNIDWARHQIESSSNVCGEKLGHSNGGLNYQIEHHLFPRMSHAHYAPIQPVVQKICEEENGINYKKFGTILSNLDSTFRQVKALGSRATEFMEGL >SEQ-137 - 89.7% sequence identity to SEQ ID NO 79
MPPHARSEVSDPELSDLMKHFTRERILNHHNDKYCILGDGVYDCVNFRDKHPGGDFVDFFPGQDATPHFFMLHRHESLPSVLAEYKVGSVARDDSYVYHDPLMKQICSAVRKV
MPMQSWWAPPSWWIKACAILAATLYTDYLWIASGPTIPLAIVGLLYAAIGLNIQHDANHGSVSRNPMVNYLFGYSQDWIGGSRMLWIRQHVVGHHTHTNDHDHDPDVKGGSV
ITLSRYSLPKEFHHIQQIYFLPLIQLYGFQWVFLDAHDLIEMKYKGEKIPESYRKEKIAIGCRVFFIRKFVLPFALHFSWYTLLCTCLWMAIAALYLGFFILSHIFVGAK
SIGEDANIDWGRHQIESSSNVCGEKLGIINGGLNYQIEHHLFPRMSHAHYSKIQPVVQKVCEEGVNYKKFGTIGSNLDSTFRHLKALGSVAVYEFMEGP >SEQ-138 - 89.7% sequence identity to SEQ ID NO 79
MPPHARTKVGDPELSDLMEHFTREEILGHENDKYCILEDGVYDLNNFRDKHPGGDVLDIFPGQDATPHFWMLHQRVSPPSVLAEYKVGSVARDDSYVYHTPLYKQIKSAVRKV
IPMGEWWAPPSWWNIKACAILAATLYTDYWIASGPTIPLAIVIGLLYAAIGLNIQHDANHGSVSRNPMVNRLFGYSQDWIGGSRMLWIRQHVVGHHTHCNRHQHDPDVKGGSV
ITLSRTSLWMPFHHIQQIYFLPGEQLLGFQWVFLGLHDLIEMKYKGEKLPESARKERNIAIGLRIFFFIRKFVVPFALHFSWHTLLCTYLWMASAALYLGFFILSHIFVGAG
SLPPEAKNIDWGRHQIESSSNVGGEKLGILNGGLNFQIEHHLFPRMSHAHYSKIQPVVQKVCEENGVNYKKFPTILSNLDSTFKQIGALGSVAVEFLEGL >SEQ-139 - 89.7% sequence identity to SEQ ID NO 79
MPPHSRTKVSDPELSALMKHFTREKKLNHTNDDYCILGDGVYDLTAFRDKHPGGDVLDFFPGQDATPHFFMLHQYESLPAVLAEYKVGSIARDDSYVYTALMKQIKSAVRAV
MPMGEWWAPPSWYIKACAILAATLYTDYLWIASGPTILLAIVSGLLFAAIGLNIQHDANHGSVSRNPMVNRLFGYSQDWIGGSRMLWIREHVVNHLHTNRHQHDPDLKGGSV
ITLSRTDLPKPFHHIQQYYFLPGIQLLGFQWVFLGLHDLIEWKYKGEPLPESYRKERNIAVGLRVFFIRFFIIPFWLEFSWYTLLCTYLWMAIAALYLGFFILSHIFVGAK
SLPEDANIDWARRQIESSSNVCGEKLGIHSNGGLNFQIEHHLFPRMSHAHYSKIQPVVQKVCEENGVNYKKFPTILSNLDSTFRHVKALGSVAVEFMEGP >SEQ-140 - 89.4% sequence identity to SEQ ID NO 79
MPPHSRTKVSDPELSDMKHFTREEILNHTRDKYCILEDGVYDATAFRDKHPGGDYIDFFPGQDATPHFYMLHRYESLPSVLAEYKVGSVARDDSYVQHDELMLQLKAAVRAVM
PMQEWWAPPSWYIKACAILAATLYLDYLWIASGPTIPLGIVLGLLYAAIGLNIQHDANHGSVSRNPVVNRLFGYSQDWIGGSRMLWIRQHVVGHHLHSNEHQHDPDIKGGSAI
RLSPYSLPKEWHHIQQLYFLPGIQLLGFQWVFLGLHDLIEMKYKGEKLPPSVRKERNIAIGCRVFFWIRKFVVPFALHFSWYTLLCTYLWMAIGALYLGFFVLSHIFVGAKS
LPEDAKNVDWARHQIESSSNVCGEKLGINGGLNYQIEHHLFPRMSHAHYSKIQPVVRKVCEENGINYKHFPTILSNLDSTFRQVKALGSVPTEFMEGL

Figure 3 (continued)

>SEQ-141 - 89.4% sequence identity to SEQ ID NO 79
MPPHSRTKVSDAELSDLMKHFTREEILNDTNDKYCILEDGVYDLTNFRDKHPGGDVLDFFPGQDATPGFWMFHQYAWLPSVLAEYKVGSIARDDSYVQYTPLMLQIKCAVRKV
LPMQSWWAPPSWYIKACAILIATLYTDYLWIASGPTIPLAIVIGLLYAAIGLNIQHDANHGSVSRNPMVNRLFGYSQDWIGGSRMLWIREHVVGHHTHCNRIQHDPDIKGGSV
ITLSPSSLWLEWHHIQQYYFLPLEQLLGFQWIFLGLHDLIEWKYEGEKIPESYRKLRNIAIGCRVFFFIRKFAIPFALHFSWYTLLCTYLWMATAALYLGFFFILSHIFVGAK
SLPEDANIDWARRQIESSSNVCGEWLGISNGGLNYQIEHHLFPRMSHAHYSKIQPVVQKVCEENGVNYKKFPTILSNLGSTFQHVKALGSVAVEFMEGL >SEQ-142 - 89.4% sequence identity to SEQ ID NO 79
MPPHSRTKVGSDPELRDLMKHFTREEILNHTRDKYCILEDGVYDLTNFRDKHPGGDVVDFFPGQDATPGFYMLHQYESLPSVLAKYFVGSVARDDSYVYHDPLQKQIKSAVRK
IMPRQEWWAPPSWWIKACAILAATLYLDYLWIAKGPTIFLAIISGLLYAAIGLNIQHDANHGSVSRNPMVNRLFGYSQDWIGGSRMLWLRQHVVGHHTHCNRHQHDPDVKGGS
VIKLKPTSLWLEFHHIQQYYFLPLDQLLGFQWIFLGLHDLIEMRYKGEKLPPSYRKERNPAIGCRVFFFIRKFVVPFALHFSWYTLLCTYLWVAIGALYLGFFFILSHIFVGA
KSLPEDANIDWARHQIESSSNVGGDKLGYSNGGLNYQIEHHLFPRMSHAHYSKIQPVVQRVCEENGINYKKFGTILSNLDSIFQQVKALASVPVEYMEGL >SEQ-143 - 89.4% sequence identity to SEQ ID NO 79
MPPHARTKVSDPELSDAKHFTREEILNHTNDKLCILEDGVYDAPNFRDKHPGGDVLDFFPGQDATPHFYMLHQYEWPPSVLAEYKVGSVARDDSYTQATPLMKQIKSAVRKVM
PMGEWWAPPSWYIKACALLAATLHTDYLWIASGPTIPLAIVSGLLYAAIGLNIQHDANHGSVSRNPMVNRLFGYSQDWIGGSMMLWIRQHVVGHHTHSNRHQHDPDVKGGSVI
KLSRYSLPLEFHHIQQIYFLPGDQLYGFQWVFLGLHDLIEMKYKGEKISESYRKERNPAIGCKVFFFIRKFVVPFWLHFSWYTLLCVCLWMATAAFYLGFFFILSHNFVGVKS
LGPDAKNVDWARHQIESSSNVCGEWLGISNGGLNYQIEHHLFPRMNHAHYSKIQPVVQKVCEENGVNYKKFPTILSNLGSTFRQVKALGSVAVYNEFLAGL >SEQ-144 - 89.4% sequence identity to SEQ ID NO 79
MPPHSATKVSDPELSDMKHFTREKILDHTNDKYCILEDGVYDCPNFRDKHPGGDVLDFFPGQDATPHFFEYHQHEWLPSVLAEYFVGSVDRDDSYVYHTSLMKQIKAAVRGIM
PRQEWWAPPSWYIKACAILAATLYTDYLWIASGPTIPLAIVSGLLYAAIGLNIQHDANHGSISRNPMVNRLFGYSQDWIGGSRMLWIRQHVVGHHTHCNRHDHDPDLKGGSVI
KLSRYDLPKEFHHIQQYYFLPLIQLLGFQWVFLDLHDLIEWKYKGEKLPESCRPLRNIAIGLRIFFWIRKFVVPFALHFSWYTLLCTCLWMATAALYLCFFFILSHIFVGIKS
LPEDAKNIDWARHQIENSSNVCGEKLGISNGGLNYQIEHHLFPRMSHAHYSKIQPVVQKVCEENGVNYKKFGTILSNLDSTFKQLGALGSRATEFMAGL >SEQ-145 - 89.4% sequence identity to SEQ ID NO 79
MPPHSRTKVSDDPELKDLMKHFSYEEILNDTNDKYCILGDGVYDATNFRDKHPGGDVLDIFGGRDATPHFYELHQYESLPSVLAEYKVGSVDRDDSYVYHDPLMLQIKSAVRK
VMPMQEWWAPPSWYIKACAILVATLYTDYLMIASGPTIPLAIVLGLLYAAIGLNIQHDANHGSISRNPMVNRLFGYSQDWIGGSRMLWIREHVVGHHTHCNDHQHDPDIKGGS
AITLSRYSLPKEWHHIQQYYFLPLIALLGFQWVFLGLHDLIEWKYKGEKIPESYRPERNIAIGLRVFFFIRKFALPFALHFSWHTLICTYLWMAIGAFYLGFFFILSHIFVGI
KSLPEDANVDWARHQIESSSNVCGEKLGHSNGGLNYQIEHHLFPRMSHAHYSKIQPVVRKVCEDNGVNYKKFPTILSNLDSMFRQVKALGSRATEFMEGL >SEQ-146 - 89.4% sequence identity to SEQ ID NO 79
MPPHSGTKVSDDPELSDLMKHFTYEEIANHTNDDYCILEDGVYDLVNFRDEHPGGDVLDFFPGQDATPGFYMLHRYESLPAVLAEYKVGSVERDDSYVHHDPLMKQICSEVRK
IMPMQEWWAPPSWWIKACAILAATLYTDYLWIASGPTIPLAIVSGLLFAAIGLNIQHDANHGSVSRNPMVNRLFGYSQDWIGGSRVLWIRQHVVGHHTHCNEVQHDPDVKGGG
VITLSRTSLPKEFHHIQQYYFLPLDQLLGFQWVFLDLHDLLEMKWKGEKLPESARPERNIAIGLKVFFFIRKVVVPFWLQFSWHTLLCTYLWMATAALYLAFFFILSHIFVGA
KSIPPDANIDWARHQIESSSNVCGEKLGISNGGLNYQIEHHLFPRMSHAHYSPIQPVVQKVCEENGVNYKKFPTILSNLDSTFRQIKALGSVATEFMEGL

Figure 3 (continued)

>SEQ-147 - 89.2% sequence identity to SEQ ID NO 79
MPPHSRTKGSAPELSDMKHFSRERILNHTNDDYCILEDGVYDLTNFRDKHPGGDFLDFFPGQDATPHFYMFHQYEWLPSVLAEYGVGSVARDDSYVQHTPLMKQLKSAVRKVM
PMQEWWAPPSWYIKACAILAATLYTDYLWIAKGPTIPLAIVSGLLFAAIGLNIQHDANHGSISRNPMVNRLFGYSQDWIGGGRMLWIREHVVGHHTHCNEIQHDPDVKGGSVI
TLSPYDLWKEFHHIQQYYFLPLIQLYGFKWVFLGLHDLIEMKYKGEKLPESARKERNIAVGLRVFFFIRKVVVPFALHFTWYTILCTYLWMAIAALYLGFFFILSHIFVGAKS
LGPDANVDWARHQIESSSNVGGEKLGHSNGGLNFQIEHHLFPRMHHAHYAKIQPVVQKICEENGVNYKKFGTILSNLDSMFSQVKALGAVAVEFMEGL >SEQ-148 - 89.2% sequence identity to SEQ ID NO 79
MPPYSRTKVSVPELSDMKHFTREEILNHTNDKLCIVEDGVYDCTNFRDKHPGGDVLDLFPGQDATPHFYMFHQYEWLPSVLARYKVGSVARDDSYVYHTPLMKQIKSDVRKIL
PMQEWWAPPSWYIKACAILVAALYLDYLWIASGPTIFLAIVSGLLYAAIGLNIQHDANHGSVSRNPMVNRLFGYSQDWIGGGMMLWIRQHVVGHHTHCNDIQHDPDVKGGSVI
KLSRTSIPLEWHHLQQYYFLPLIQLLGFQWVFLDLHDLIEMKYKGEKLPESYRKERNIAIGLRVFFFIRKFVVPFALHFSWYTLLCTYLWMAIAALYLGFFFILSHLFVGAKS
LPPDGSIDWARHQIESSSNVGGEKLGISNGGLNYQIEHHLFPRLSHAHYAKIQPVVQKVCEENGVNYKKFPTILSNLGSMFRQVKALGSVPVEFMAKL >SEQ-149 - 89.2% sequence identity to SEQ ID NO 79
MPPHSRTEVGDPELSDMKHFTREEIANHTNDDYCILEDGVYDLTCFRDKHPGGDVLDFFPGQDATPHFFMFHQYESLPSVLAEYGVGSVARDDSYVQHDPLMKQIKSAVRKIM
PMGSWWAPPSWWIKACAILAATLYTDYLWIARGPTIPLAIILGLLYAAIGLNIQHDANHGSVSRNPMVNRLFGYSQDWIGGNRMLWIRQHVVGHHTHCNRHDHDPDVKGGSVI
RLSRYSLPKPWHHIQQIYFLPLIQLLGFQWVFLGLHDLIEMRYEGEKLPESYRKERGIAVGLRVGFFIRKFVVPFWLHFSWYTLLCTCLWMAIGAFYLGFFFILSHIFVGAKS
LPEDGNIDWARHQIESSSNVGGEKLGYSNGGLNFQIEHHLFPRMSHAHYAKIEPVVQKVCEENGVNYKKFPTILSNLDSTFRQVKALGSVPVEFMEGL >SEQ-150 - 89.2% sequence identity to SEQ ID NO 79
MPPHSGTKVSDPELSAMKHFAREEILNHTNDKICILEDGVYDLVNFRDKHPGGDYLDFFPGQDATPHFYMLHRYESPPSVLAEYKVGSVARDDSYVYHTPLMKQIKSAVRKVM
PMQEWWAPPSWYIKACAILAATLHTDYLMIASGPTIPLAIVSGLLFAAIGLNIQHDANHGSVSRNPMVNRLFGYAQDWIGGSRMLWIQQHVVGHHTHCNRIDHDPDVKGGSVI
TLSRTSLPLEFHHIQQLYFLPLIQLYGFQWVFLDLHDLIEMKYKGEKLPELYRPEYGIAIGLRVFFWIRKFIVPFALHFSWYTLLCTYLWMAIGAFYLGFFFILSHIFVGAKS
LGEDGNIDWARHQIESSSNVCGEKLGYMNGGLNYQIEHHLFPRLSHAHYSKIQPVVRKVCEENGVNYKKFGTIASNLDSLFRYLGGLGSVPVYEFMEGL >SEQ-151 - 89.2% sequence identity to SEQ ID NO 79
MPPHSRTKVSDPELSDMKHFTREEKLNDTNDDYCILEDGVYDLSNFRDKHPGGDYVDFFGGQDATPHFYMLHQRESPPSVMSKFKVGSVARDDSYVYHTPLMKQIKSAVRKVM
PKQEWWAPPSWYIKACAILIATLFTDYLMIASGPTIPLAIVSGLLYAWIGLNIQHDANHGSVSRNPMVNRLFGYSQDWIGGSRMLWIQQHVVGHHTHCNRHQHDPDVKGGSAI
TLSPYSLWKEWHHIQQYYFLPLIQLLGFQWVFLGLHDLIEMKYKGEPLPPSYRKERNIAIGLRVFFWIRKVVVPFWLQFSWYTLLCTYLWMAIGALYLGFFFILSHIFVGAKS
LPEDANIDWARHQIESSSNVCGEKLGYLNGGLNFQIEHHLFPRMSHAHYSTIQPVVQKVCEENGVNYKKFGTILSNLDSMLRQVGALGSVPTEFLEGL >SEQ-152 - 89.2% sequence identity to SEQ ID NO 79
MPPYSRTKVVSDPELSDAKHFTREEILNHTRDKYCILEDGVYDCTNFRDKHPGGDVLDFFPGQDATPHFYMLHRYVWLPSLLSEFKVGSVARDDSYVYHTELHKQICSAVRKV
IPMQEWWAPPSWYIKACAILVATLYTDYLWIASGPTIFLGIIIGLLYAAIGLNIQHDANHGSISRNPMVNRLFGYSQDWIGGSRMLWIRQHVVGHHTHCNRHQHDPDIKGGSV
ITLSRVDLPKEFHHIQQLYFLPLIQLYGFQWVFLGLHDLIEMKWKGEKLSESARKEYAIAIGLRVFFFIRKVVVPFALHFSWYTLLCTYLWVAIGALYLGFFFILSHIFIGAK
SLPEDAKNIDWARHQIETSSNVCGEWLGIMNGGLNYQIEHHLFPRMSHAHYAKIQPVVQKVCEENGVNYKHFGTILSNLDSLFRHVKALGSVAVEFMAGL

Figure 3 (continued)

>SEQ-153 - 89.2% sequence identity to SEQ ID NO 79
MPPHSATKVSVPELSDMKHFTREEILNHTNDDYCILEDGVYDLTNFRDKHPGGDFLDLFGGQDATPHFYMLHQRASPPSVLAEYKVGSVDRDDSYVQHTPLMKQIKSAVRKII
PKQEWWAPPSWYIKACALLIATLYTDYYWIASGPTIPLAIVIGLLYAAIGLNIQHDANHGAVSRNPVVNRLFGYSQDWIGGSMMLWIRQHVVNHHTHCNRHQHDPDVKGGSVI
TLSPYSLPKEWHHIQQYFLPGEQLLGFQWVFLGLNELIEMKYKGEKLPEIYRKERAIAVGLRVFFFARKFVIPFALHFSWYTLLCTCLWMASAALYLGFFFILSHIFVGAKS
LGPDAKNIEWARHQIESSSNVCGEKLGISNGGLNYQIEHHLFPRMSHAHYSPIQPVVQKVCEKNGVNYKKFGTIGSNLDSTFRQVKALGSRAVYEFMEGL >SEQ-154 - 89.2% sequence identity to SEQ ID NO 79
MPPHSRTKVSAPELSDLMKHFTREEILNHTRDKYCIVGDGVYDLTNFRDKHPGGEFLDFFGGQDATPHFYMLHQYEWPPSILAEYKVGSLDRDDSYVHHESLMKQIKSDVRKI
MPMQEWWAPPSWYIKACALIVATLYTDYYWIASGPTIPLAIVSGLLYAAIGLNIQHDANHGAVSRNPMVNRLFGYSQDWIGGSRLLWIRQHVVGHHTHCNDHQHDPDVKGGSV
LTLSRYSLWMEFHHLQQYFLPLEQLLGFQWIFLGLHDLIEMRYKGEPLPPSYRKERGIAIGCRVFFFIRKFVPFALHFSWYTLLCTYLWMAIAALYLGFFFILSHIFIGAK
SLPPDANIDWARHQIESSSNVCGDWLGISNGGLNYQIEHHLFPRMNHAHYSKIQPIVQKVCEENGVNYKKFGTILSNLDSMFRQVKALGSVAVYEFMEGL >SEQ-155 - 89.2% sequence identity to SEQ ID NO 79
MPPHARTKVVGDDPELSALMKHFTREEILNHTNDDYCILEDGVYDCSAFRDKHPGGDVLSFFPGQDATPHFYMFHQRESPPAVLAEYKVGSVARDDSYVYHTPLMLQIKSAVR
KVMPMGEWWAPPSWWIKACAIIAATLYLDYLMIARGPTIPLAIVSGLLFAAIGLNIQHDANHGSISRNPMVNRLFGYSQDWIGGSRMLWIRQHVVNHHTHCNRHQHDPDVKGG
SVIRLSPYSLWKEFHHIQQYYFLPLDQLYGFQWVFLDLHDLIEMKYKGEKLSELYRKERNPAIGLRVFFWARKVVVPFALHPTWYTLLCTYLWMAIATLYLGFFFILSHLFVG
VKSLPEDANIDWARHQIESSSNVCGEKLGISNGGLNYQIEHHLFPRMSHSHYSPIQPVVQKVCEENGVNYKKFPTILSNLDSTFRQVKGLGSRAVEFMGGL >SEQ-156 - 89.2% sequence identity to SEQ ID NO 79
MPPHSRTKVSDPELSDMKHFTREKILNHTRDDYCILEDGVYDLTCFRDKHPGGDVLDFFPGQDATPHFYMLHQRASLPSVLSEYKVGSVARDDSYVHHDALMKQIKSAVRGIM
PMQEWWAPPSWYIKACAILIATLHTDYYWIASGPTIPLAIVSGLLYAAIGLNIQHDANHGSVSRNPMVNRLFGYSQDWIGGSRVLWIRQHVGHHTHCNRVQHDPDVKGGSVI
RLGRYDLPKEFHHLQQIYFLPGEQLLGFKWVFLGLHDLIEMKYKGEKIPESYRKERNIAIGLRVGFFIRFIALPFALHFSWYTLLCTCLWMAIATLYLGFFFILFVGAKS
LPEEGNIEWARHQIESSSNVCGEWLGISNGGLNYQIEHHLFPRLHHAHYSKIQPVVRKVCEENGVNYKKFGTILSNLDAMFRQVKALGSVAVYNEFMEGL >SEQ-157 - 89.2% sequence identity to SEQ ID NO 79
MPPHSGTKVSDPELSDLMKHFTREEILNHTNDKYCILEDGVYDSTCFRDEHPGGEVLDFFPGQDATPGFYELHQYEWLPSVLAEYKVGSVARDDSYVYHTPGMKQIKSAVNKV
MPKQEWWAPPSWYIKACAILAAALYTDYLMIASGPTIPLAIVSGLLFEAAIGLNIQHDANHGSVSRNPMVNRLFGYGQDWIGGGRMLWLQOHVVGHHTHCNRVQHDPDVKGGSV
LQLSRYDLWKEFHHIQQIHFLPMDALLGFQWVFLGLHDLIEMKYKGEKLPEIYRKDRNIAIGLKVFFFIRKFIIPFALQFSWYTLLCTYLWVCVAAFYLGFFFILSHIFIGAK
SLPEDAKNIDWARHQIESSSNVCGEWLGISNGGLNYQIEHHLFPRMSHAHYSKIAPVVQKVCEENGVNYKKFPTIASNLDSLFRQVKALGSVAVEFMEGL >SEQ-158 - 89% sequence identity to SEQ ID NO 79
MPPHSRTKGSDDPELSDLAKHFTRTKKLNHENDRKYCILGDGVYDSTCFRDKHPGGDVLDFFPGQDATPHFYMYHQYESLPSVLAEYKVGSIDRDDSYVQHTPLMKQIKADVRK
VMPMQEGWAPPSWYIKACAILAATIHLDYLMIARGPTIPLAIVLGLLYAAIGLNIQHDANHGSVSRNPMVNRLFGYSQDWIGGSRLLWIRQHVVGHHLHCNRHQHDPDVKGGG
AIRLSRYSLPKEFHHIQQYFLPLEQLYGFQWVFLGLNDLLEMKYKGEKLPPSCRKERNIAIGLRVFFWIRKFVVPFALHFSWYTLLCIYLWMATAALYLGFFFILSHIFVGA
KSLPPDANIDWARRQIESSSNVCGEKLGISNGGLNYQIEHHLFPRMSHAHYSKIQPVVRKVCEENGVNYKKFPTIGSNLDSTFRQVKALGSVPVEFMEGL

Figure 3 (continued)

```
>SEQ-159 - 89% sequence identity to SEQ ID NO 79
MPPHAGTEVSDPELSDMKHFTREEILNHTNDKICILEDGVYDCTAFRDKHPGGDVLDFFPGQDATPHFWMFHQRESPPSVLAEYKVGSVARDDSYVYHTEGMLQIKSAVRKVM
PKQEWWAPPSWYIKACAILAATLYTDYLWILSGPTIFLAIVSGLLYAAIGLNIQHDANHGSVSRNPMVNRLFGYSQDWIGGNMMLWIRKHVVGHHTHCNDHQHDPDVKGGSVI
TLSPYSGWMEFHHIQQYFLPLDQLYGFQWVFLGLHELIEWKYGEKLPEICRKERGIAIGLRVFFWIRKFVVPFALHFSWYTLLCTYLWMAIAALYLAFFVLSHIFVGAKS
LPPDANIDWARHQIESSSNVCGEKLGILNGGLNYQIEHHLFPRMSHSHYSTIQPVVQKVCEENGVNYKHFGTILSNLDSTFRQVKALGSVPIEFMEGL >SEQ-160 - 89% sequence identity to SEQ ID NO 79
MPPHSRTKVGDPELSDMKHFTREEILNHTNDDYCILEDGVYDCNNFRDKHPGGDFLDFFPGQDATPHFYMLHQRESLPSVLAEFKVGSVARDDSYVYHDPGHKQIKCAVRGVM
PRQEWWAPPSWYIKACAILAATLYTDYLWIASGPTIPLAIVIGLLYAAIGLNIQHDANHGAVSRNPMVNRLFGYSQDWIGGSRVIWIRQHVVGHHLHCNDVQHDPDIKGGSVI
TLSPYSGWKEFHHIQQLYFLPLEQLYGFQWVFLGLHDLIEMKYKGEPLPESYRPEYNIAIGLRIFFARKFVVPFALEFSWYTLLCTYLWMAIAALYLGFFFILSHIFVGVKS
LPPDANVDWARHQIENSSNVCGEKLGISNGGLNYQIEHHLFPRMSHAHYSKIQPVVQKVCEENGVNYKKFPTILSNLDSLFKQIKALGAVAVEFMEGL >SEQ-161 - 89% sequence identity to SEQ ID NO 79
MPPHSRTKGSDPELSDAKHFTRERILNDTNDKLCILGDGVYDLTAFRDKHPGGDFLDFFPGQDATPHFYMLHQYEWLPSVLAKYKVGSIARDDSYVHHDPLMKQIKSAVRAVL
PRQEWWAPPSWYIKACAILAATLYTDYLWIASGPTIPLAIISGLLYAAIGLNIQHDANHGSVSRNPMVNRLFGYSQDWIGGSRMIWIRQHVVGHHLHTNRHDHDPDVKGGSVI
TLSRYSIWKEFHHIQQLYFLPLDQLLGFQWVFLGLHDLIEMRYKGEKLPPSYRPLRNIAIGLRVGFFIRFFVVPFALHFSWYTLLCTYAWMCIGALYLGFFFILSHIFVGAGS
LPEDAKNIDWARHQIETSSNVCGEKLGISNGGLNYQIEHHLFPRMSHSHYSPIQPVVQKVCEENGVNYKKFGTILSNLDSLFSQIKALGSVPTYEFMEGL >SEQ-162 - 89% sequence identity to SEQ ID NO 79
MPPHGRTKVSDPELSDMEHFSRTEILNHTNDKLCILEDGVYDLTNFRDKHPGGDYLDFFPGQDATPHFYEFHQYESPPSVMAEYFVGSVARDDSYVYHTPLMKQIKSAVNKVL
PMGSWWAPPSWYIKACAILAATLYTDYLMIASGPTIPLAIVSGLLYAAIGLNIQHDANHGGVSRNPMVNRLFGYSQDWIGGSRMIWIRQHVVGHHTCNRVQHDPDVKGGGVI
TLSPYSLWMEFHHIQQYFLPLEVLYGFQWVFLGLHDLIEWKYGEKLSESYRKDRNPAIGLRVFFARFFVLPEALEFSWYTLLCTYLWMAIGAFYLGFFILSHIFIGAKS
IPEDAKNIDWVRHQIESSSNVCGEKLGISNGGLNYQIEHHLFPRMSHAHYSKIQPVVQKVCEENGVNYKKFGTIGSNLDSIFKQVKALGSVATYEFMEGP >SEQ-163 - 89% sequence identity to SEQ ID NO 79
MPPHSATKVSDVPELSDLMKHFSREEILNHTNDKICILGDGVYDLTNFRDKHPGGDVIDEFPGQDATPHFYMLMQYESPPSVLAEYKVGSVARDDSYVYHDPLMKRICSAVRK
VMPMQEWWAPPSWWIKACALLAATLYTDYLWLASGPTIPLAIVLGLLYAAIGLNIQHDANHGSVSRNPMVNRLFGYSQDWIGGSRMIWIRQHVVGHHIHTNRHQHDPDVKGGS
AIRLSPTSLPKEFHIQQYFLPLIQLLGFQWVFLGANDLIEMKYGEGKLPESYRPERNIAIGCRVFFIRKEIVPFALEFTWYTLLCTYLWMATAALYLGFFFILSHIFIGA
KSLGPDGNIDWARHQIENSSNVGGEKLGISNGGLNYQIEHHLFPRMHHAHYSTIQPVVQKVCEEMGVNYKKFGTIGSNLDSTLRQVKGLGSVPTEFMEGL >SEQ-164 - 89% sequence identity to SEQ ID NO 79
MPPHSRRKVGSDPELRDMKHFTREELNHNNDKYCILEDGVYDLTNFRDKHPGGDVLDFFPGQDATPHFYMLHQRESLPSILAEYKVGSVARDDSYVYATSLMKRIKSEVRGV
MPMGSWWAPPSWYIKACAILAATLYLDYLWIASGPTIPLAIVSGLLFAAIGLNIQHDANHGSVSRNPAVNRLFGYSQDWIGGNRMLWIREHVVGHHLHTNRHQHDPDIKGGSV
LQLSRVSIPKEFHHIQQYFLPLIQLYGLYGFQWVFLGLMNGGLNYQIEHHLFPRMSHAHYAKIAPVVQKVCEENGVNYKKFGTIGSNLDSTFRQIGALGSVAVEFMEGL
SLPEDGNIDWARHQIESSSNVCGEKLGIMNGGLNYQIEHHLFPRMSHAHYAKIAPVVQKVCEENGVNYKKFGTIGSNLDSTFRQIGALGSVAVEFMEGL
```

Figure 3 (continued)

>SEQ-165 - 88.8% sequence identity to SEQ ID NO 79
MPPHSRTKVSDPELSDLMKHFTREEILGDTNDDYCILGDGVYDLTNFRDKHPGGDYLDFFPGQDATPHFYQLHQYEWPPSVLAEFGVGSVLAEFGVGSVARDDSYVHHTPLMKRIKSAVNKV
MPRQEWWAPPSWWIKACAILAATLYTDYLWIASGPTILLAIVIGLLYAAIGLNIQHDANHGSVSRNPMVNRLFGYSQDWIGGSMMLWLRQHVVGHHTHCNDHQHDPDVKGGSV
LTLSRYSLPMEFHHIQQIYFLPLEQLLGFQWVFLDLHDLIEMKYKGEKLPESYRKERNIAIGCRIFFFVRKFVVPFALHPSWYTLLCTYLWMATAALYLGFFFILSHIFVGIK
SLPEDANIDWARHQIESSSNVCGDKLGYINGGLNYQIEHHLFPRLSHAHYSKIQPVVQKVCEKNGVNYKHFPTIASNLGSTFRQLGALGAVAVYEFMGGL >SEQ-166 - 88.8% sequence identity to SEQ ID NO 79
MPPHSRTKVSDPELSDMEHFTREEILNHTNDKLCILEDGVYDLTNFRDKHPGGDVLDFFPGQDATPHFYMFHRYESLPSVLAEYKVGSIARDDSYVYATELMKQIKSAVRKVI
PMQEGWAPPSWYIKACAILIATLYLDYLWLLSGPTIPLAIVSGLLYAAIGLNIQHDANHGSVRNPMVNRLFGYGQDWIGGSRLLWIRQHVVGHHTHCNRHQHDPDVKGGSVI
QLSRYDGMEFHAIQQYFLPLEQLYGFKWVFLGAHDLIEMKWEGEKLPELYRKERNIAIGLRVFFFARKFVIPFALHFSWYTLLCVYLWVAIAALYLGFFFILSHLFVGAKS
LPEDGSVEWARHQIESSSNVCGEKLGISNGGLNYQIEHHLFPRMSHAHYSKIQPVVQKVCEEMGVNYKKFGTIGSNLGSTFQQVGALGAVAVEFMEGL >SEQ-167 - 88.8% sequence identity to SEQ ID NO 79
MPPHSATKVVSAPELSDMKHFSREKILNHENDKICILEDGVYDLTNFRDKHPGGDVLDLFPGQDATPHFYMLHQYESLPSVMAEYKVGSVARDDKYVHHTPLMKQIKSEVRKV
MPMQEWWAPPSWYIKACAILAATLYTDYLWIASGPTIPLAIVSGLLFAAIGLNIQHDANHGSVSRNPMVNRLFGYSQDWIGGNRMLWIRQHVVGHHLHSNRHDHDPDLKGGSV
IQLSRYSLPKEFHHLQQYFLPLIQLYGFQWVFLGAHDLIEWRWKGEKLPPSYRPEFNIAIGCRIFFFIRKFVVPFALHPSWYTLLCTYLWMATAALYLGFFFILSHLFVGVK
SLPEDANIEWARRQIESSSNVGGEKLGILNGGLNYQIEHHLFPRMSHAHYSPIQPVVQKVCEENGVNYKKFGTIGSNLGSTFRQVKALGSRATEFLEGL >SEQ-168 - 88.8% sequence identity to SEQ ID NO 79
MPPHSRRKVSDAPELRDMKHFSREEILDHNNDKYCILEDGVYDLTAFRDKHPGGEVLDFFPGQDATPHFYMYHQYESPPSVLAEYKVGSVARDDSFVYHTELMKQICAAVNKV
MPMQSWWAPPSWYIKACALLAATLYLDYLWIASGPTILLAIVSGLLYAAIGLNIQHDANHGALSRNPMVNRLFGYSQDWIGGSRMLWIRQHVNHHTHCNRHDHDPDVKGGSV
IQLKRYSLPLPFHHIQQYFLPLIQLLGFQWVFLGLHELIEMKYKGEKLPELYRPERNIAIGCRVFFFIRKFAVPFALHFSWHTLLCTYLWMAIAAFYLCFFFILSHIFVGAG
SLGEEANIDWARHQIESSSNVCGEKLGISNGGLNYQIEHHLFPRMSHAHYSKIQPVVQKVCEEMGVNYKKFGTILSNLDSTLRQVKALGSVPVEYMAGL >SEQ-169 - 88.5% sequence identity to SEQ ID NO 79
MPPHSRSEVSDDPELSDLMKHFTREEILNHTNDDLCILGDGVYDLTNFRDKHPGGEVLDFFPGRDATPHFFMLHQREWLPSVLAEYKVGSVARDDSYVYHEPGMKQIKSAVRK
VMPQEGWAPPSWYIKACAILVATLYTDYLWIASGPTIFLAIVSGLLYAAIGLNIQHDANHGAVSRNPMVNRLFGYSQDWIGGSRLLWIRQHVVGHHTCNRIQHDPDVKGGS
AIQLSRYSLMEWHHIQQIYFLPLDQLLGFWIFLGLHDLIEWKYEGEPLPESYRKERNPAIGLRVFFFIRKFVIPFALHPSWYTLLCTCLWMATASLYLGFFFILSHIFVGA
KSLPEDASVEWARHQIETSSNVGGEKLGISNGGLNFQIEHHLFPRMSHAHYSKIQPVVQKVCEENGINYKHFGTILSNLGSTFRQVKALGSTFRQVEFMAKL >SEQ-170 - 88.3% sequence identity to SEQ ID NO 79
MPPHGRTKVGDPELSDMKHFTREEILNHTNDKYCILEDGVYDASAFRDKHPGGDFLDFFPGQDATPGFYMFHQHEWPPSVLAEYKVGSVARDDSYVYHTPLMKQICSAVRKVM
PKGEWWAPPSWYIKACAILAATLYLDYLWIASGPTIPLAIVIGLLYAAIGLNIQHDANHGAVSRNPMVNRLFGYSQDWIGGSRLLWIRQHVVGHHTHCNDVQHDPDLKGGSVI
TLSRTSLPKEFHLQQYFLPLEALYGFQWVFLGLHDLIEMKYKGEKLSPSYRKLRNIAIGLRIFFFARKFVIPFALHFSWYTLLCTCAWMATATLYLGFFFILSHIFVGAKS
LPEDGNVDWARHQIESSSNVCGEKLGHLNGGLNYQIEHHLFPRMSHAHYSTIEPVVQKVCEENGVKYKKFGTILSNLDSTFKQVKALGSVAVEFMEGL

Figure 3 (continued)

>SEQ-171 - 88.3% sequence identity to SEQ ID NO 79
MPPHSRKKGSDPELSDLAKHFTRERILNHTRDKYCILEDGVYDLTNFRDKHPGGDVLDFFPGQDATPHFYMLHQYEWPPSVLARYGVGSVARDDSYVYADPLMLQICSAVNKV
IPMQEWWAPPSWWIKACAILVATLFTDYLWLAKGPTIPLAIVSGLLFAAIGLNIQHDANHGSVSRNPMVNRLFGYSQDWIGGSRMLWLRQHVVGHHTHCNRIDHDPDVKGGSV
IRLSRYSLPKEFHIQQIYFLPLIQLLGFQWVFLGLHDLIEMRYKGEKLPESYRKERNPAVGLRIFFFARKEVIPFALHFSWYTLLCTCAWMAIAALYLGFFFILSHIFVGIK
SLGPDANVDWARHQIESSSNVCGEWLGILNGGLNYQIEHHLFPRMNHAHYSKIQPIVQKVCEENGVNYKHFGTILSNLDSTFRQIKALGSRAVEFMEGL >SEQ-172 - 88.3% sequence identity to SEQ ID NO 79
MPPHSRTKGSDVAELSDLMKHFTRTEIANHTRDKYCILEDGVYDANNFRDKHPGGDVIDIFPGQDATPHFFELHQYASPPSVLSEYKVGSVARDDSYVYHTPLMKQIKSAVRK
VMPKGEGWAPPSWYIKACAILAATLYLDYWIARGPTIPLAIVSGLLYAAIGLNIQHDANHGSVSRNPMVNRLFGYSQDMIGGSRMLWIRQHVGHHTHCNRHDHDPDVKGGS
VITLSRYSIPKEWHHIQQLYFLPLIQLYGFQWVFLDLHDLIEMKWEGEPLPESYRKERNPAIGLRLFFVRKIVVPFALHFSWYTLLCTYLWMAIGALYLCFFFILSHNFVGI
KSIPEDASIDWARHQIESSSNVGGEWLGYLNGGLNYQIEHHLFPRMSHAHYSKIQPVVQKVCEENGVNYKKFGTILSNLDSTFRHVKALGAVAVYEFMEGL >SEQ-173 - 88.3% sequence identity to SEQ ID NO 79
MPPHGRTKVSDVPELSDLAKHFSREEILNHTNDKYCILEDGVYDATNFRDKHPGGDVIDFFPGRDATPHFWMLHRYEWPPSVLAEYGVGSVARDDKFVHHTALMKQIKSAVRA
VLPMQEWWAPPSWYIKACAILAATLFTDYLWIASGPTIPLAIVLGLLYAMIGLNIQHDANHGSVSRNPVVNRLFGYSQDWIGGGRMLWIRQHVGHHTHCNRHDHDPDVKGGS
VITLKRVSLPLEWHHIQQYYFLPLIQLLGFQWVFLGLNDLIEWKYKGEKLSEICRKERNIAIGLRVFFVRKFVVPFALHFSWHTLLCTYLWMAIAAALYLGFFFILSHIFVGA
KSLGEDANIDWARHQIETSSNVGGDKLGYSNGGLNYQIEHHLFPRMNHAHYAKIQPVVQKVCEENGVKYKHFGTILSNLDSTFRQVKALGSVAVYEFLAGL >SEQ-174 - 88.3% sequence identity to SEQ ID NO 79
MPPHAGTKVSDDPELRDLMKHFTREEILNHTNPKYCILGDGVYDATNFRDKHPGGDVLDFFPGQDATPGFYMFHQYESLPGLLARYKVGSVARDDSYTHHDPLMKQLCSAVRK
VMPMQEWWAPPSWYIKACAILIATLYLDYLMIASGPTIPLAIVLGLLFAAIGLNIQHDANHGSVSRNPMVNRLFGYAQDWIGGSRMLWIRQHVGHHTHCNDVQHDPDVKGGS
VIQLSRYSLPKPFHLQQYYFLPLEQLYGFQWVFLGLHDLIEMKYKGEKLPESYRKEFNPAIGLRVGFFIRFVVPFALQFSWYTLLCTCLWMAVAAFYLGFFFILSHIFVGV
KSLPEDANIDWARHQIESSSNVCGEKLGISNGGLNYQIEHHLFPRLSHAHYAPIQPVVQKVCEDNGINYKKFGTILSNLDSTFRQVKALGAVATYEFLAGL >SEQ-175 - 88.3% sequence identity to SEQ ID NO 79
MPPHSRTKVSDPELSDLMKHFTREEILNHNNDKYCILEDGVYDLTNFRDKHPGGDVLDLFPGQDATPGFYMLHQHVSLPSVLAEYKVGSVDRDDSYVYHTPLQKQLCSAVRKV
IPMQEWWAPPSWYIKACAILAASGPTIPLAIVLGLLYAAIGLNIQHDANHGGVSRNPAVNLFGYAQDWIGGGRMLWIQKHVVNHHIHTNDVQHDPDVKGGSA
IKLKRYSLWKEFHHIQQYFLPLIQLLGFQWVFLGLHDLIEMKYKGEPLPPSARPERGIAIGLRVFFFIRKFVLPFALHFSWYTLLCIYLWMAIAALYLGFFFVLSHIFVGAK
SLPPDANIDWARHQIESSSNVCGEKLGISNGGLNYQIEHHLFPRMNHAHYSKIQPIVQRICEDNGINYKKFPTIGSNLDSLFSQVKALGSVAIYEFMGGL >SEQ-176 - 88.1% sequence identity to SEQ ID NO 79
MPPHSRKKVGSDPELSDMKHFTREEKLNHTNDKYCILGDGVYDLTNFRDKHPGGDVLSFFPGQDATPHFFMLHRKESPPSVLAEYKVGSVERDDKYTHTPLMKQIKAAVRKV
MPRGEWWAPPSWYIKACAILAATLYTDWLWLASGPTIPLAIVSGLLHELIEMKYKGEPLPESYRKERNPAIGCKVFFFIRKFAVPFWLQPSWYTLLCVYLWMAIAAFYLGFFFILSHIFVGAK
ITLSPTDLWLPFHHIQQYFLPLDQLYGFQWVFLGLHELIEMKYKGEPLPESYRKERNPAIGCKVFFFIRKFAVPFWLQPSWYTLLCVYLWMAIAAFYLGFFFILSHIFVGAK
SIPEDAKSIDWARHQIESSSNVCGEKLGISNGGLNYQIEHHLFPRMSHAHYSKIQPVVQRVCEENGINYKKFGTIGSNLDSLLRQVKALGSVAVEFMEGL

Figure 3 (continued)

>SEQ-177 - 88.1% sequence identity to SEQ ID NO 79
MPPHSRTKVSDPELSDLMKHFTREEILNHTNDKICILEDGVYDATNFRDKHPGGDVLDIFPGQDATPHFYMLHQRESPPGLLAKYKVGSVARDDSYVYHEPLMKQIKCEVNKV
LPKQEWWAPPSWYIKACAILVATLYLDYLPLIVLYGFKWVFLGLHDLIEMRYKGEKLPELYRKEFNIAIGLRLFFEIRKFVVPFALHPSWHTLLCTCLWVASAALYLGFFFILSHIFVGAG
LTLSPYSLPKEFHHIQQLYFLPLIVLYGFKWVFLGLHDLIEMRYKGEKLPELYRKEFNIAIGLRLFFEIRKFVVPFALHPSWHTLLCTCLWVASAALYLGFFFILSHIFVGAG
SLPEDASIDWARHQIESSSNVGGEKLGISNGGLNYQIEHHLFPRMSHAHYSKIQPVVQKCEENGINYKKFGTILSNLDSLFRHLGAIGSRATYEFMEGL >SEQ-178 - 87.9% sequence identity to SEQ ID NO 79
MPPHGRTEGGDPELSDMKHFTYEEILNHTRDKICIVEDGVYDLTNFRDKHPGGDVVDLFGGQDATPHFYMLHQYESPPSILAEYKVGSIARDDSYVYHTPGMKRIKAEVRKVM
PKGEWWAPPSWYIKACAILAAALYTDYLMIASGPTIPLAIVSGLLYAMIGLNIQHDANHGSVSRPMVNRLFGYSQDWIGGSRMLWIQQHVVGHHIHCNRVQHDPDVKGGSVI
KLSPYSLPMEFHHIQQYFLPLEQLYGFQWVFLGLHDLLEWKYKGEKIPEIARKERGIAIGLRVFFVVRKFVVPLALEFTWHTLLCTYLWMCVAAFYLGFFFILSHIFVGIGS
LPEDAKNIDWARHQIESSSNVCGEKLGYSNGGLNYQIEHHLFPRMSHAHYSKIQPVVQKCEENGVNYKKFGTILSNLDSMFRQVKALGSVAVYEFMEGL >SEQ-179 - 87.9% sequence identity to SEQ ID NO 79
MPPHSRTKVSDPELRDMKHFTRTEILNHTRDKYCILGDGVYDLTCFRDKHPGGDVLDFFPGQDATPHFYMLHQYEWPPAVLAEYKVGSVARDDSYVHHTPLMKQIKSEVRKVM
PMQEWWAPPSWYIKACALLVAALYTDYLMIASGPTIPLAIVSLLYAMIGLNIQHDANHGAVSRNPMVNRLFGYSQDWIGGSRMLWIREHVVGHHLHCNRIQHDPDVKGGSAI
RLSRYSLWKPWHHLQQIYFLPLIQLLGFKWVFLDLHDLIEMKYKGEKLPELYRPLRNIAIGCRIFFEFIRKFALPFWLHFTWYTLLCTCLWMAIASLYLAFFFILSHIFVGIKS
LGEDANIDWARHQIESSSNVGGDKLGYSNGGLNYQIEHHLFPRMSHAHYSKIEPVVQKCEENGVNYKKFPTILSNLDSTFRQVKALGSVAVEFMEGL >SEQ-180 - 87.9% sequence identity to SEQ ID NO 79
MPPHSRTKVSDPELKDMKHFAREEILNHTNDKYCILEDGVYDLTNFRDKYCILEDGVYDLTNFRDKHPGGDVLDFFPGQDATPHFYMLHRYAWPPSVLAEYKVGSVDRDDSYVYHTSLYLQIKSAVRKVI
PMQEWWAPPSWWIKACALLAATLYTDYLMIASGPTIPLGIVSGLLYAAIGLNIQHDANHGSVSRNPMVNRLFGYSQDWIGGSRMLWIREHVVGHHTCNRHQHDPDVKGGVL
KLSRYDIWMEFHHIQQLYFLPLEQLGFQWVFLGLHDLIDMKWKGEKLSESARPERGIAIGLRVFFWIRKFVVPFALHFSWYTLLCTYAWVASAAFYLGFFFILSHIFVGAKS
LPPDASVDWARHQIETSSNVGGEKLGISNGGLNYQIEHHLFPRMSHAHYSKIQPVVQKCEENGVNYKKFPTIASNLDSTFSQVKALGSVAVEFMGGI >SEQ-181 - 87.4% sequence identity to SEQ ID NO 79
MPPHARSKVSDPELSDMKHFTRERILNDENDKICILEDGVYDLTNFRDKHPGGDYVDFFGGQDATPHFYMFHQYESPPSVLAEYKVGSVARDDSFVYHEPLMKQIKSAVRKVM
PRGEWWAPPSWYIKACAILAAILYTDYLMIARGPTIPLAIVLGLLFAAIGLNIQHDANHGSLSRNPMVNRLFGYSQDWIGGSRLIWLREHVVGHHTCNRHDHDPDVKGGVL
KLSRSSLPMEFHHIQQIFLPLEQLGFQWVFLGLHDLIEMKYKGEPLPELYRKERNIAVGLRVFFEFIRKFVVPFALHPSWHTLICICLWMAIGALYLGFFFILSHIFVGIKS
LPEDAKNIDWARHQIESSSNVCGEKLGHSNGGLNYQIEHHLFPRMSHSHYSKIEPVVQKCEDNGINYKKFGTILSNLDSTLRQLGALGSRPVEFMEGL >SEQ-182 - 87.4% sequence identity to SEQ ID NO 79
MPPHSRTKVVSDPELSDMEHFTRTEILNHENDKYCILEDGVYDLSNFRDKHPGGEYLDFFPGQDATPGFFQLHQYASLPGVLARYKVGSIDRDDSYVQHTSLMKQICSAVRKV
MPRGEWWAPPSWWIKACAIIIATLYLDYLWIASGPTIPLAIVSGLLFAAIGLNIQHDANHGALSRNPMVNRLFGYAQDWIGGSMMLWIQQHVVGHHTHCNRVQHDPDVKGGGV
ITLSPTSLPLEFHHIQQYFLPLIQLLGFQWYFLPLIQLLGFQWVFLHFSWYTLLCIYLWMAIGALYLAFFFILSHIFVGAK
SLPEDGKNIDWARHQIESSSNVGGEKLGISNGGLNYQIEHHLFPRMSHSHYSKIQPVVQKCEENGINYKKFGTILSNLDSIFRQVGALGSVAVEFLEGL

Figure 3 (continued)

>SEQ-183 - 87.2% sequence identity to SEQ ID NO 79
MPPHSRTKGSDDPELSDLMKHFTREKILNDNDKYCIVGDGVYDATNFRDKHPGGEFLDFFPGQDATPHFYMFHQYESLPSILAEYKVGSLERDDSYTYHDSLMKQIKSAVRK
VIPMQEWWAPPSWYIKACAILIATLYLDYLWIASGPTIFLAIVLGLLYAWIGLNIQHDANHGSVSRNPMVNRLFGYSQDWIGGSRVLWIRQHVGHHIHSNRHQHDPDVKGGG
VITLSRVSLPKEFHHIQQYFLPLEQLLGFKWVFLGLHDLIDMKYKGEKLPESYRKERGIAIGCRVGFFARKIVVPFALQFSWHTLLCVYLWVAIATLYLAFFILSHIFIGA
KSLPPDANIDWARHQIESSSNVCGEKLGIMNGGLNYQIEHHLFPRMSHAHYSTIQPVVQRVCEENGVNYKHFGTIGSNLDSTFRQVKALGSVAVEFLEGL >SEQ-184 - 87% sequence identity to SEQ ID NO 79
MPPHAATEVSVPELSDLMKHFSRTEILNDTRDKYCILEDGVYDLPNFRDKHPGGDYVDFFPGQDATPHFYMLHQYEWPPSVLAEYGVGSVARDDSFVHHDPLMLQLCSDVRKV
MPMGEWWAPPSWWIKACALLAATLYLDYLWLASGPTIPLAIISGLLYAAIGLNIQHDANHGSVSRNPMVNRLFGYSQDWIGGSRMLWIRQHVGHHIHCNRHQHDPDVKGGGV
ITLSRYDLPMEFHHLQQLYFLPLIALLGFQWVFLGLHDLIEWKYKGEKLPEIYRKERGIAIGLRVFFWARFFVVPFALEFSWYTLLCTYLWMAIAALYLGFFFILSHIFVGAK
SLPEDASIDWARRQIETSSNVGGEWLGIINGGLNFQIEHHLFPRMSHAHYSTIQPVVQKVCEENGVNYKKFGTIGSNLDSTFKQVKALGSVPVYEFMAGL >SEQ-185 - 87% sequence identity to SEQ ID NO 79
MPPHSRTKVSVPELSDMKHFTREEILNDTNDDYCILEDGVYDLTNFRDKHPGGDFIDIFPGRDATPHFYMYHQRESPPSVLSEYKVGSLERDDSFVHYTALMKQLKSEVNKIM
PMGEGWAPPSWYIKACALVATLYTDYLMIAKGPTIPLSIVIGLLYAWIGLNIQHDANHGSVSRNPMVNRLFGYSQDWIGGSRMLWIQQHVGHHIHCNRIQHDPDVKGGSVI
RLSRYSLWKEFHHIQQYFLPLEQLLGFQWVFLGLNDLIDMKWKGEKLPESARKERNIAIGLKVFFIRKFVVPFALQFSWYTLLCTYAWMAIAALYLGFFILSHIFVGAKS
LPEEANIDWARHQIESSSNVCGEWLGHLNGGLNYQIEHHLFPRMSHAHYSKIQPVVQKVCEENGVNYKKFGTILSNLDSTFRQVKALGSVPIEFMEGL >SEQ-186 - 85.4% sequence identity to SEQ ID NO 79
MPPHSRTKVSDDAELKDLMKHFAREEKLNHTNDKLCILEDGVYDLPNFRDEHPGGDVLSFFPGRDATPHFYQLHQKESPPALLAEYKVGSVARDDSYVQYTPLHLQICADVNK
VMPRQEWWAPPSWWIKACALLAATLYTDYLWIASGPTIPLSIVLGLLFAWIGLNIQHDANHGGVSRNPMVNRLFGYGQDWIGGSRMLWIQQHVVGHHTHCNRHQHDPDVKGGS
VLKLSRYDLWLEWHHIQQYFLPGEQLYGFQWVFLGLHELIEMKYKGEKLPESCRKERNPAIGLRVGFWIRKIVVPFALHFSWYTLLCTCLWMAIGSLYLGFFVLSHIFVGA
KSLPEDASIDWARRQIESSSNVCGDRKLGISNGGLNYQIEHHLFPRMSHAHYSKIQPVVQKVCEDDGVNYKKFGTILSNLDSTFRQLKALGSVPEFLEGL

Figure 3 (continued)

ENZYMES, ENZYME COMPONENTS AND USES THEREOF

This application is a continuation application of U.S. patent application Ser. No. 14/416,981, which is a National Stage application of International Application No. PCT/IB2013/056243, filed Jul. 30, 2013, which claims the benefit of U.S. Provisional Application No. 61/679,100, filed Aug. 3, 2012, and which also claims priority under 35 U.S.C. § 119 to European Patent Application No. 12179241.0, filed Aug. 3, 2012; the aforementioned applications are hereby incorporated herein by reference in their entirety.

REFERENCE TO SEQUENCE LISTING SUBMITTED VIA EFS-WEB

This application was filed electronically via EFS-Web and includes an electronically submitted sequence listing in .txt format. The .txt file contains a sequence listing entitled "72174A_Subseqlisting" created on Jun. 22, 2018, and is 626,728 bytes in size. The sequence listing contained in this .txt file is part of the specification and is hereby incorporated by reference herein in its entirety.

The invention in principle pertains to the field of recombinant manufacture of fatty acids. It provides nucleic acid molecules which encode lysophospholipid-coenzyme A synthase (LACS), desaturases, elongases and elongase components. The invention also provides recombinant expression vectors containing desaturase, KCS, KCR and/or LACS nucleic acid molecules, host cells into which the expression vectors have been introduced, and methods for large-scale production of long chain polyunsaturated fatty acids (LCPUFAs), e.g. arachidonic acid (ARA, omega-6 unsaturated fatty acid), eicosapentaenoic acid (EPA, omega-3 unsaturated fatty acid) and/or docosapentaenoic acid (DHA, omega-3 unsaturated fatty acid).

Fatty acids are carboxylic acids with long-chain hydrocarbon side groups that play a fundamental role in many biological processes. Fatty acids are rarely found free in nature but, rather, occur in esterified form as the major component of lipids. As such, lipids/fatty acids are sources of energy (e.g., b-oxidation). In addition, lipids/fatty acids are an integral part of cell membranes and, therefore, are indispensable for processing biological or biochemical information.

Fatty acids can be divided into two groups: saturated fatty acids formed of single carbon bonds and the unsaturated fatty acids which contain one or more carbon double bonds in cis-configuration. Unsaturated fatty acids are produced by terminal desaturases that belong to the class of nonheme-iron enzymes. Each of these enzymes are part of an electron-transport system that contains two other proteins, namely cytochrome $b_5$ and NADH-cytochrome $b_5$ reductase. Specifically, such enzymes catalyze the formation of double bonds between the carbon atoms of a fatty acid molecule, for example, by catalyzing the oxygen-dependent dehydrogenation of fatty acids (Sperling et al., 2003). Human and other mammals have a limited spectrum of desaturases that are required for the formation of particular double bonds in unsaturated fatty acids and thus, have a limited capacity for synthesizing essential fatty acids, e.g., long chain polyunsaturated fatty acids (LCPUFAs). Thus, humans have to take up some fatty acids through their diet. Such essential fatty acids include, for example, linoleic acid (C18:2) and linolenic acid (C18:3). In contrast, insects, microorganisms and plants are able to synthesize a much larger variety of unsaturated fatty acids and their derivatives. Indeed, the biosynthesis of fatty acids is a major activity of plants and microorganisms.

Long chain polyunsaturated fatty acids (LCPUFAs) such as docosahexaenoic acid (DHA, 22:6(4,7,10,13,16,19)) are essential components of cell membranes of various tissues and organelles in mammals (nerve, retina, brain and immune cells). For example, over 30% of fatty acids in brain phospholipid are 22:6 (n-3) and 20:4 (n-6) (Crawford, M. A., et al., (1997) Am. J. Clin. Nutr. 66:1032S-1041S). In retina, DHA accounts for more than 60% of the total fatty acids in the rod outer segment, the photosensitive part of the photoreceptor cell (Giusto, N. M., et al. (2000) Prog. Lipid Res. 39:315-391). Clinical studies have shown that DHA is essential for the growth and development of the brain in infants, and for maintenance of normal brain function in adults (Martinetz, M. (1992) J. Pediatr. 120:S129-S138). DHA also has significant effects on photoreceptor function involved in the signal transduction process, rhodopsin activation, and rod and cone development (Giusto, N. M., et al. (2000) Prog. Lipid Res. 39:315-391). In addition, some positive effects of DHA were also found on diseases such as hypertension, arthritis, atherosclerosis, depression, thrombosis and cancers (Horrocks, L. A. and Yeo, Y. K. (1999) Pharmacol. Res. 40:211-215). Therefore, appropriate dietary supply of the fatty acid is important for human health. Because such fatty acids cannot be efficiently synthesized by infants, young children and senior citizens, it is particularly important for these individuals to adequately intake these fatty acids from the diet (Spector, A. A. (1999) Lipids 34:S1-S3).

Currently the major sources of DHA are oils from fish and algae. Fish oil is a major and traditional source for this fatty acid, however, it is usually oxidized by the time it is sold. In addition, the supply of fish oil is highly variable, particularly in view of the shrinking fish populations. Moreover, the algal source of oil is expensive due to low yield and the high costs of extraction.

The biosynthesis of LCPUFA and the incorporation of LCPUFA into membrane lipids or triacylglycerides proceeds via various metabolic pathways (Abbadi 2001, European Journal of Lipid Science & Technology 103:106-113). In bacteria such as *Vibrio*, and microalgae, such as *Schizochytrium*, malonyl-CoA is converted into LCPUFA via an LCPUFA-producing polyketide synthase (Metz 2001, Science 293: 290-293; WO 00/42195; WO 98/27203; WO 98/55625). In microalgae, such as *Phaeodactylum*, and mosses, such as *Physcomitrella*, unsaturated fatty acids such as linoleic acid or linolenic acid are converted in a plurality of desaturation and elongation steps to give LCPUFA (Zank 2000, Biochemical Society Transactions 28: 654-658). Desaturation takes place either on acyl groups bound to Coenzyme A (acyl-CoA) or on acyl groups of membrane lipids, whereas elongation is biochemicaly restricted to acyl chains bound to CoA. In mammals, the biosynthesis of DHA comprises a chain shortening via beta-oxidation, in addition to desaturation and elongation steps. In microorganisms and lower plants, LCPUFA are present either exclusively in the form of membrane lipids, as is the case in *Physcomitrella* and *Phaeodactylum*, or in membrane lipids and triacylglycerides, as is the case in *Schizochytrium* and *Mortierella*. Incorporation of LCPUFA into lipids and oils, as well as the transfer of the fatty acid moiety (acyl group) between lipids and other molecular species such as acyl-CoA, is catalyzed by various transferases, such as acyltransferases and transacylases. These enzymes are known to carry out the incorporation or interexchange of saturated and unsaturated fatty acids (Slabas 2001, J. Plant Physiology 158: 505-513, Frentzen 1998, Fett/Lipid 100: 161-166, Cases 1998, Proc. Nat. Acad. Sci. USA 95: 13018-13023, Lu et al 2009, Proc. Nat. Acad. Sci. USA vol 106: no. 44: 18837-18842). One group of acyltransferases having three distinct enzymatic activities are enzymes of the "Kennedy pathway", which are located on the cytoplasmic side of the membrane system of the endoplasmic reticulum (ER). The ER-bound acyltransferases in the microsomal fraction use acyl-CoA as the activated form of fatty acids. Glycerol-3-phosphate acyltransferase (GPAT) catalyzes the incorporation of acyl groups at the sn-1 position of glycerol-3-phosphate. 1-Acylglycerol-3-phosphate acyltransferase, also known as lysophosphatidic acid acyltransferase (LPAAT), catalyze the incorporation of acyl groups at the sn-2 position of lysophosphatidic acid (LPA). After dephosphorylation of phosphatidic acid by phosphatidic acid phosphatase (PAP), diacylglycerol acyltransferase (DGAT) catalyzes the incorporation of acyl groups at the sn-3 position of diacylglycerols. Further enzymes directly involved in TAG biosynthesis—apart from the said Kennedy pathway enzymes—are the phospholipid diacylglycerol acyltransferase (PDAT), an enzyme that transfers acyl groups from the sn-2 position of membrane lipids to the sn-3 position of diacylglycerols; diacylglyceroldiacylglycerol transacylase (DDAT), an enzyme that transfers acylgroups from the sn-2 position of one diacylglycerol-molecule to the sn-3 position of another diacylglycerol-molecule and phosphatidylcholine:diacylglycerol cholinephosphotransferase (PDCT), an enzyme transfers the polar phosphatodycicholine headgroup from the sn-3 position of an poly unsaturated phospholipid (e.g. containing 18:2n-6 or 18:3n-3), to the sn-3 position of a saturated (e.g. containing 18:0) or mono unsaturased (e.g. containing 18:1n-9) diacylgcylerole Lysophospholipid acyltransferase (LPLAT) represents a class of acyltransferases that are capable of incorporating activated acyl groups from acyl-CoA to membrane lipids, and possibly catalyze also the reverse reaction. More specifically, LPLATs can have activity as lysophosphophatidylethanolamine acyltransferase (LPEAT) and lysophosphatidylcholine acyltransferase (LPCAT). Further enzymes, such as lecithin cholesterol acyltransferase (LCAT) can be involved in the transfer of acyl groups from membrane lipids into triacylglycerides, as well. Generally, fatty acids in a cell are bound as thioesters. Formation of these thiosesers from free fatty acids occurs by the action of a Lysophospholipid-Coenzyme A Synthase (LACS).

EPA and ARA are both delta (d) 5 essential fatty acids. They form a unique class of food and feed constituents for humans and animals. EPA belongs to the n-3 series with five double bonds in the acyl chain. EPA is found in marine food and is abundant in oily fish from North Atlantic. ARA belongs to the n-6 series with four double bonds. The lack of a double bond in the ω-3 position confers on ARA different properties than those found in EPA. The eicosanoids produced from AA have strong inflammatory and platelet aggregating properties, whereas those derived from EPA have anti-inflammatory and anti-platelet aggregating properties. ARA can be obtained from some foods such as meat, fish and eggs, but the concentration is low.

Gamma-linolenic acid (GLA) is another essential fatty acid found in mammals. GLA is the metabolic intermediate for very long chain n-6 fatty acids and for various active molecules. In mammals, formation of long chain polyunsaturated fatty acids is rate-limited by Δ6 desaturation. Many physiological and pathological conditions such as aging, stress, diabetes, eczema, and some infections have been shown to depress the Δ6 desaturation step. In addition, GLA is readily catabolized from the oxidation and rapid cell division associated with certain disorders, e.g., cancer or inflammation. Therefore, dietary supplementation with GLA can reduce the risks of these disorders. Clinical studies have shown that dietary supplementation with GLA is effective in treating some pathological conditions such as atopic eczema, premenstrual syndrome, diabetes, hypercholesterolemia, and inflammatory and cardiovascular disorders.

Although biotechnology offers an attractive route for the production of specialty fatty acids, current techniques fail to provide an efficient means for the large scale production of unsaturated fatty acids. Accordingly, there exists a need for an improved and efficient method of producing unsaturated fatty acids, such as DHA, EPA and ARA.

As DHA is a particularly important polyunsaturated fatty acids, there is a high need for efficient production of this fatty acid. A particularly critical step in the production of DHA is the delta-4 desaturation step. This step is performed by delta-4 desaturases. These enzymes utilize docosapentaenoic acid (DPA, 22:5 delta7,10,13,16,19) bound to ACP, to CoA or in phospholipids as substrate to produce the respective DHA bound to ACP, to CoA or in phospholipids. DPA, in turn, is produced by a delta-5 elongase. Generally, these elongases elongate acyl-CoA fatty acids. It has been observed that desaturation efficiency can be greatly increased if a desaturase is employed which use, as substrates, fatty acids bound to the same backbone as those used during elongation. Specifically, desaturation efficiency has been shown to be increased by providing an acyl-coA desaturase (Domergue et al, Biochem. J. 2005, 483-490).

There is thus a need for delta-4 desaturases having high desaturation efficiency when paired with a delta-5 elongase. So far, such desaturases were only known from Pavlova/Rebecca species (Uniprot identifiers Q6VPV2_PAVLU and A0PJ29_9EUKA, putatively also D6NST0_9EUKA). This has made it difficult to screen for further desaturases having high desaturation efficiency when paired with a delta-5 elongase, because due to the similarity of the delta-4 desaturases of Pavlova/Rebecca, it is not possible to ascertain whether amino acids conserved in these desaturases are required for their function, or if they are retained only because not enough time has passed to create further mutations.

The inventors now provide a delta-4 desaturase having high desaturation efficiency when paired with a heterologous delta-5 elongase. The delta-4 desaturase has a very low sequence identity to the Pavlova/Rebecca desaturases mentioned above. The invention thus also provides a list of allowable mutations to the delta-4 desaturase, such that only few of these mutations would abolish the delta-4 desaturase activity as such or the high desaturation efficiency when paired with a delta-5 desaturase. Accordingly, the invention provides a method for screening for further delta-4 desaturases having high desaturation efficiency when paired with a heterologous delta-5 elongase.

DETAILED DESCRIPTION OF THE INVENTION

Specifically, the invention provides a delta-4 desaturase having at least 60%, preferably at least 69%, even more preferably at least 74% and even more preferably at least 81% sequence identity to the amino acid sequence according to any of SEQ ID NO. 79, 86 or 85, wherein the sequence preferably also comprises a motif selected from "KHPGG (SEQ ID NO: 187)", "QHPGG(SEQ ID NO: 188)" or "RHPGG(SEQ ID NO: 189)", preferably a motif selected from "KHPGGD(SEQ ID NO: 190)", "QHPGGD(SEQ ID NO: 191)" or "RHPGGD(SEQ ID NO: 192)", and a motif selected from "GLNIQHDANHG(SEQ ID NO: 193)" or "HVVGHH(SEQ ID NO: 194)", preferably a motif selected from "AAIGLNIQHDANHG(SEQ ID NO: 195)" or "QHVVGHH(SEQ ID NO: 196)".

It was particularly surprising that a delta-4 desaturase having high desaturation efficiency when paired with a heterologous delta-5 desaturase could be provided which has such low sequence identity to the above mentioned delta-4 desaturases of Pavlov/Rebecca. It was also particularly surprising that in the motiv "EHPGG(SEQ ID NO: 197)" conserved in Pavlova/Rebecca the first amino acid G, which is an acidic amino acid, could be replaced by K, which is a basic amino acid, without abolishing the high desaturation efficiency. It can thus be extrapolated that surprisingly also "QHPGG(SEQ ID NO: 188)" and "RHPGG(SEQ ID NO: 189)" are valid motifs in place of "EHPGG(SEQ ID NO: 197)". Also, it was surprising that the motif "HVVMHH (SEQ ID NO: 198)" conserved in Pavlova/Rebecca delta-4 desaturases could be replaced by "HVVGHH(SEQ ID NO: 194)", replacing hydrophobic methionine M by the inconspicuous glycine G. And it was surprising that the first amino acid E of the conserved Pavlova/Rebecca motif "EHVVMHH(SEQ ID NO: 199)" could be replaced by Q, again exchanging an acidic amino acid for a non-acidic amino acid. It was unexpected that such significant changes in amino acid properties in conserved motifs would be possible without abolishing the desaturation efficiency when compared with a heterologous delta-5 elongase.

Figure 2:
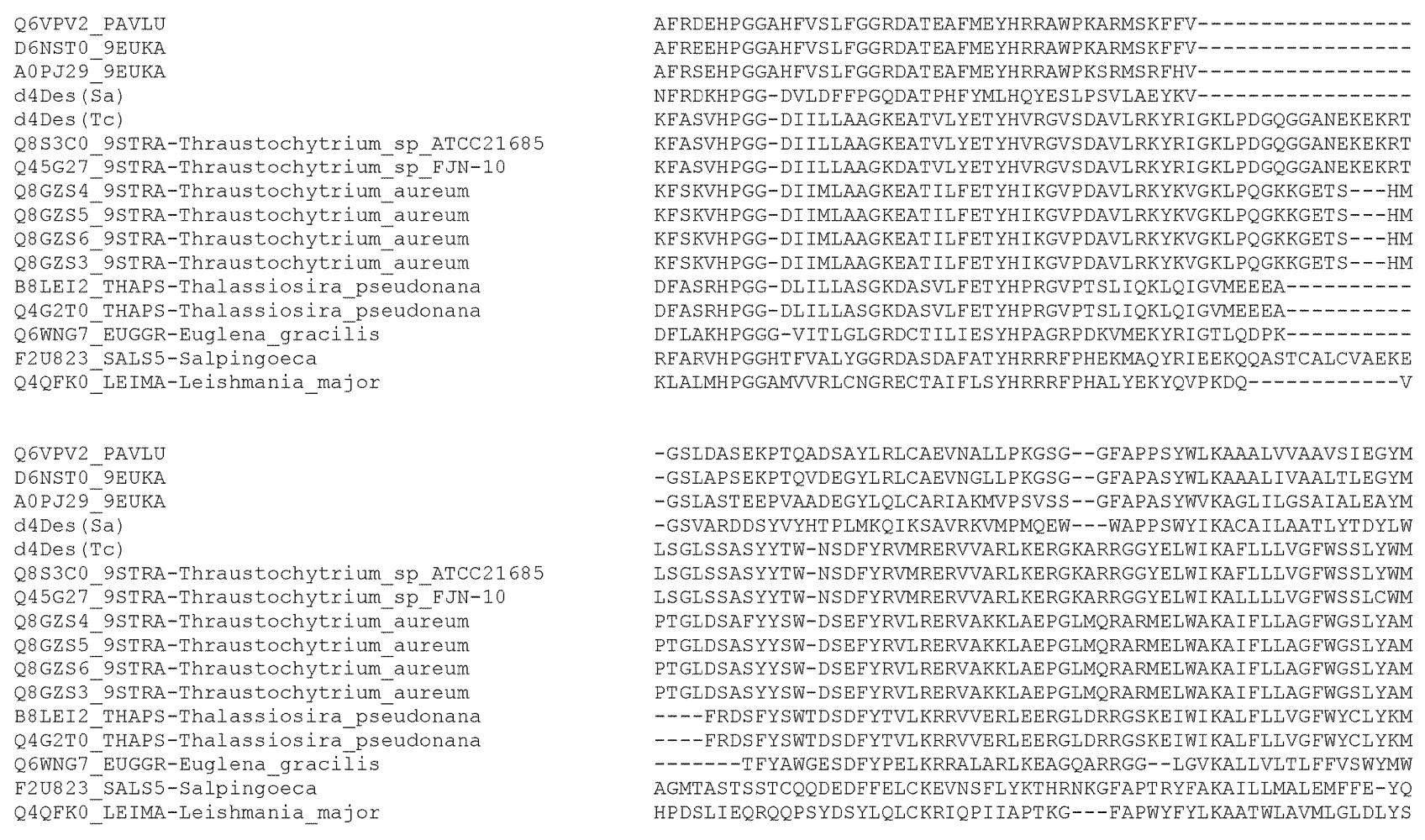
Figure 2:
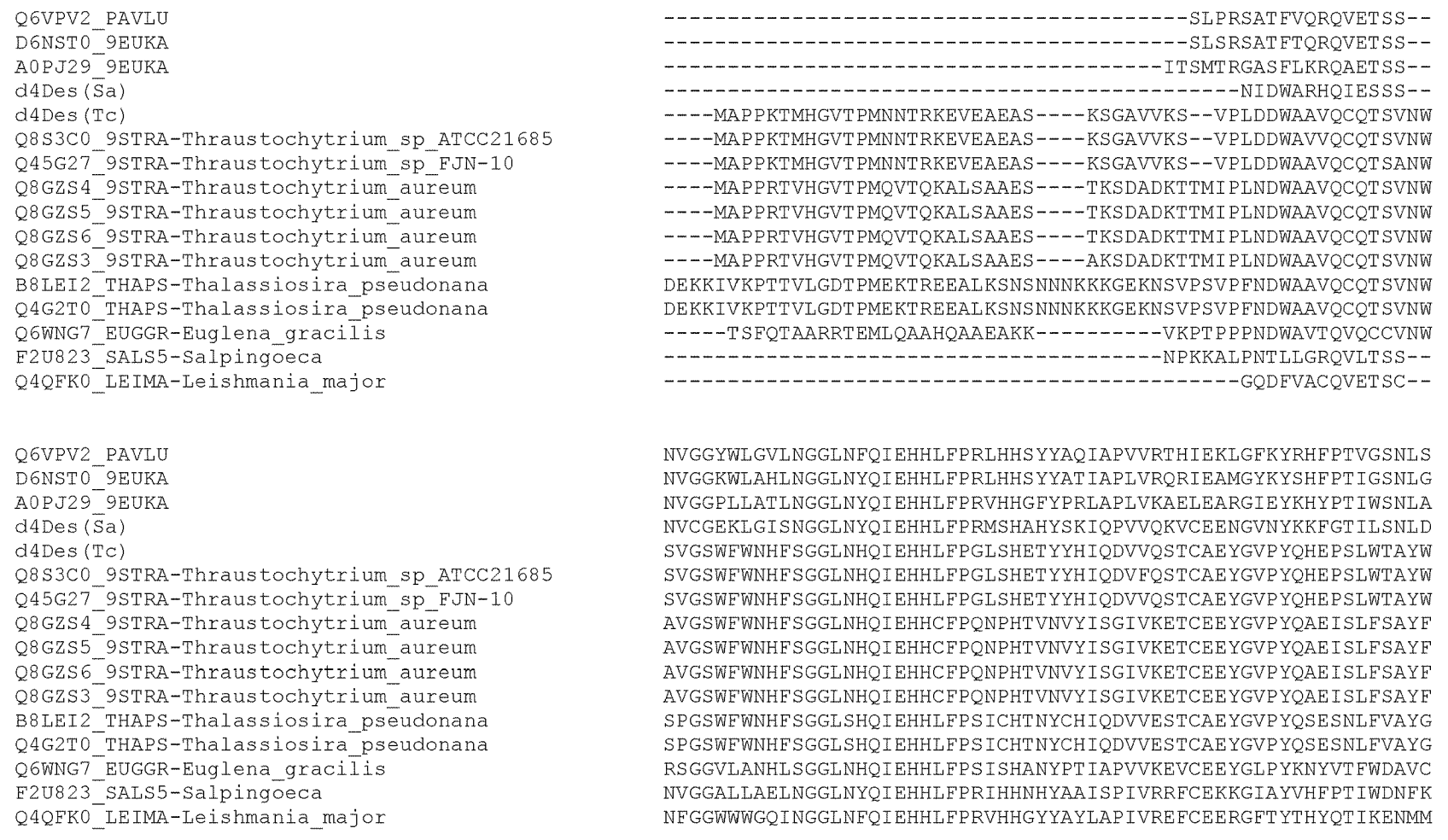

The delta-4 desaturase of the present invention at least comprises the following conserved sequence motifs, wherein "X" denotes any amino acid: "HPGG(SEQ ID NO: 200)", "QDWIGG(SEQ ID NO: 201)", "NGGLN(SEQ ID NO: 202)", "QIEHHLFPR(SEQ ID NO: 203)" and "IGLNIQHDXNHG(SEQ ID NO: 204)". As shown in the alignment of FIG. 2, these sequences are required for delta-4 desaturase activity.

Preferably, the delta-4 desaturase of the present invention comprises at least 5, more preferably at least 6, even more preferably at least 7 and most preferably all the following conserved sequence motifs, wherein "X" denotes any amino acid: "DPDXK(SEQ ID NO: 205)", "HPGG(SEQ ID NO: 200)", "NGGLNXQIEHHLFPR(SEQ ID NO: 206)", "GYXQDWIGG(SEQ ID NO: 207)", "IGLNIQHDANHG (SEQ ID NO: 208)", "YLXFFF(SEQ ID NO: 209)", "HVVXHHXH(SEQ ID NO: 210)" and "FXGXDAT(SEQ ID NO: 211)". These longer conserved sequence motifs are also found in delta-4 desaturases of genus Sphaeroforma, Pavlova or Rebecca as shown in FIG. 2.

More preferably, the delta-4 desaturase of the present invention comprises at least 5, more preferably at least 6, even more preferably at least 7, even more preferably at least 8, even more preferably at least 9, even more preferably at least 10, even more preferably at least 11, even more preferably at least 12, even more preferably at least 13, even more preferably at least 14 and most preferably all of the following conserved sequence motifs: "DPD[VILMATQ]K (SEQ ID NO: 212)", "HPGG(SEQ ID NO: 200)", "NGGLN[FWY]QIEHHLFPR(SEQ ID NO: 213)", "GY[ASGM]QDWIGG(SEQ ID NO: 214)", "Y[FI]LP(SEQ ID NO: 215)", "IGLNIQHDANHG(SEQ ID NO: 208)", "YL[AG]FFF (SEQ ID NO: 216)", "HVV[GNASKDWM]HH[LIFT]H (SEQ ID NO: 217)", "AP[PA]S(SEQ ID NO: 218)", "F[WF] [AVCGSPI]R(SEQ ID NO: 219)", "F[GP]G[RQ]DAT(SEQ ID NO: 220)", "T[LIMVFCA][LIVCA]C(SEQ ID NO: 221)", "P[LF][WA]L(SEQ ID NO: 222)", "KA[CA]A(SEQ ID NO: 223)" and "I[VIZGADE]D[GA] (SEQ ID NO: 224)". In this list, "X" again denotes any amino acid. A list of amino acids in brackets indicates that one member chosen among the members of list is present at the corresponding position of the motif, wherein each individual list is ordered in decreasing preference. For example, a motiv "PLWL (SEQ ID NO: 222)" is preferred over a motiv "PLAL (SEQ ID NO: 222)" or "PFWL(SEQ ID NO: 222)" or "PFAL(SEQ ID NO: 222)", and one of these four motifs must be present in the more preferred delta-4 desaturases of the present invention. Some of the amino acids in the lists are not found in delta-4 desaturases of genus Sphaeroforma, Pavlova or Rebecca as shown in FIG. 2. However, according to the invention these new amino acids are similar enough to those amino acids found at corresponding positions in the delta-4 desaturases of genus Sphaeroforma, Pavlova or Rebecca, such that the new amino acids will generally not abolish or severely reduce the delta-4 desaturase efficiency, particularly the high efficiency of desaturation when combined with a delta-5 elongase for producing polyunsaturated fatty acids from the substrate or substrates of said delta-5 elongase.

Most preferably the delta-4 desaturase of the present invention comprises at least 5, more preferably at least 6, even more preferably at least 7, even more preferably at least 8, even more preferably at least 9, even more preferably at least 10, even more preferably at least 11, even more preferably at least 12, even more preferably at least 13, even more preferably at least 14 and most preferably all of the following conserved sequence motifs: "DPD[VQ]K(SEQ ID NO: 225)", "HPGG(SEQ ID NO: 200)", "NGGLN[YF] QIEHHLFPR(SEQ ID NO: 226)", "GY[SAM]QDWIGG (SEQ ID NO: 227)", "Y[FI]LP(SEQ ID NO: 215)", "IGLNIQHDANHG(SEQ ID NO: 208)", "YL[AG]FFF(SEQ ID NO: 216)", "HVV[GM]HH[LT]H(SEQ ID NO: 228)", "AP [PA]S(SEQ ID NO: 218)", "F[FW][AI]R(SEQ ID NO: 229)", "F[GP]G[RQ]DAT(SEQ ID NO: 220)", "T[LA][LA] C(SEQ ID NO: 230)", "P[LF][AW]L(SEQ ID NO: 231)", "KA[AC]A(SEQ ID NO: 232)" and "I[VL][GE]D[GA] (SEQ ID NO: 233)". As described above, a list of amino acids in brackets indicates that one member chosen among the members of list is present at the corresponding position of the motif, wherein each individual list is ordered in decreasing preference.

According to the invention, there is further provided a delta-4 desaturase having the amino acid sequence SEQ ID NO. 85 and optionally one or more of the following mutations: H4S, H4Y, H4Q, H4E, H4N, A5S, A5G, A5C, A5P, A5T, A5V, A6R, A6G, A6K, A6S, A6N, T7K, T7S, T7R, T7N, T7A, T7G, K8E, K8D, K8R, K8Q, V9–, V9I, V9L, V9A, G10V, G10I, G10A, G10M, G10C, G11S, G11N, G11D, G11A, G11K, D12–, S13–, D14A, D14V, D14I, D14E, D14G, D14P, P15A, P15G, P15S, P15V, P15T, R18K, R18S, R18T, R18A, R18Q, D19A, D19G, D19P, D19S, L20–, K21–, M22A, M22L, M22I, M22V, E23K, E23R, E23Q, H24Y, H24F, H24I, H24M, H24L, H24Q, H24R, H24V, F25Y, F25W, F25I, F25A, S26T, S26A, S26C, S26G, S26N, Y27R, Y27F, E28T, E28D, E28N, E28S, R29K, R29E, R29Q, R29D, I30K, I30L, I30V, L31A, L31I, N32D, N32G, N32H, N32S, N32T, N32R, N32K, N32E, N32Q, N32A, N32V, D33H, D33N, D33T, E34T, E34N, E34D, E34Q, E34R, R35N, R35K, R35H, D36P, D36E, D36N, D36S, D37E, D37K, L38I, L38V, L38M, L38F, L38Y, C39T, C39A, C39S, C39V, V41L, V41I, V41M, V41T, G42A, G42D, G42E, G44A, A48S, A48C, A48L, A48R, A48K, T49S, T49V, T49N, T49P, T49K, T49A, A50C, A50N, A50G, D53E, D53N, K54Q, K54R, A59-, D60E, D60N, D60H, F61Y, F61W, F61V, F61I, V62L, V62I, V62M, V62A, V62T, D63S, D63N, D63E, L64I, L64F, L64M, G66P, R68Q, R68H, R68D, R68N, P72E, P72D, P72Q, H73G, H73A, H73N, H73S, F75W, F75M, F75Y, E76Q, E76M, E76H, Y77F, Y77W, Y77H, Y77L, R79K, R79Q, R79H, R80H, R80K, R80Q, R80Y, R80N, E81A, E81V, E81Q, E81L, E81P, W82G, W82S, P83D, P83V, P83K, P83A, P83T, P83E, P83Q, P83M, P83L, P84K, P84R, A85S, A85G, A85C, A85T, A85P, A85V, V86I, V86L, V86M, V86R, V86A, V86T, L87M, L87I, L87V, L87F, A88S, A88C, A88G, K89R, K89E, K89Q, K89P, K89N, Y90F, Y90W, K91F, K91G, K91Y, K91L, K91W, L95I, L95V, L95M, D96A, D96E, D96G, D96P, R97K, R97P, R97Q, R97H, R97E, R97A, D98E, D98N, D98S, D99E, D99Q, S100K, S100G, S100N, S100P, Y101F, Y101W, Y101H, Y101P, V102T, V102I, V102L, Q103H, Q103E, Q103R, Q103N, Q103K, Q103D, Q103Y, H104A, H104Y, H104V, H104I, H104F, H104R, D105E, D105P, D105T, S106P, S106E, S106A, S106D, S106N, S106T, G107L, G107I, G107M, G107A, Y108H, Y108Q, Y108W, Y108M, Y108V, L109K, L109M, L109I, L109V, R110Q, R110K, R110H, R110E, L111I, L111F, C112G, C112A, C112N, C112S, C112K, A113C, A113S, A113G, E114D, E114Q, E114P, E114S, E114K, E114A, N116R, N116D, N116H, G117A, G117K, G117R, G117S, I118L, I118V, L119I, L119M, K121R, K121M, K121Q, K121L, G122W, G122Q, G122N, S123E, S123D, S123N, S123G, G124W, G124A, G124N, G125-, W126F, P129A, P129G, W131Y, W132Y, I133L, I133V, C136A, C136G, C136S, L138I, L138V, L138M, L139I, L139V, L139M, V140A, V140I, V140L, V140C, V140M, A142T, A142P, A142S, A142G, L143I, L143V, Y144F, Y144H, Y144W, Y144S, Y144T, L145I, L145V, L145M, L145F, L145T, D146E, D146N, D146Q, Y147W, Y147F, Y147H, Y147G, Y148F, Y148H, Y148L, M149W, M149L, M149I, M149F, L150I, L150V, A151L, A151C, A151G, A151S, R152K, R152S, R152N, R152Q, R152D, P154K, P154E, P154R, I156L, I156V, L157F, L157I, L157M, L157Y, L157W, L157P, A159S, A159G, A159C, A159T, A159P, A159V, I160V, I160L, I161V, I161L, I161F, L162I, L162V, L162M, L162F, L162C, L162A, L162T, L162S, L165I, L165V, Y166Y, W168G, W168A, W168C, A181S, A181G, A181C, A181T, A181P, A181V, L182I, L182V, L182M, N185H, N185Y, P186S, V187M, V187A, V187I, V187P, V188I, V188L, V188A, V188T, Y190R, Y190H, Y190W, L191C, L191I, F192L, F192I, A195S, A195G, A195M, A195Q, A195K, S202N, S202G, S202D, S202I, S202A, S202K, M203R, M203L, M203Q, M203I, M204L, M204V, M204I, M204Q, M204C, L207I, L207V, Q208R, Q208E, Q208K, Q209E, Q209K, Q209R, Q209D, Q209H, G213N, G213A, G213S, G213K, G213D, G213W, G213M, L216I, L216F, L216T, T218C, T218S, T218V, T218A, T218N, T218P, D220E, D220N, D220R, D220G, I221V, I221F, I221Y, I221H, D222N, D222Q, D222P, H223Y, H223F, H223Q, H223W, H223R, H223E, H223N, H223M, H223V, H223P, H223I, H223L, H223D, H223A, V227I, V227L, V227M, V227A, V227T, V227Q, G229A, G230H, G230N, G230D, G231S, G231N, G231A, A232V, A232I, A232I, A232G, L233I, L233V, R234K, R234Q, R234N, R234E, R234H, R234T, K236S, K236G, K236A, K236T, P237K, P237D, P237E, P237R, I238T, T238T, T238P, T238N, T238A, T238I, I238Y, D239T, D239G, D239E, G240I, G240L, G240F, G240C, G240M, G240S, W241F, W241Y, W241P, L242M, L242I, L242V, L242F, L242K, P243E, P243D, W244F, H246A, H246S, H246Y, H246G, H246N, L247I, L247V, L250I, L250V, L250M, L250F, L250Y, F252I, F252Y, L255G, L255M, L255A, L255K, L255C, L255F, E256D, E256Q, E256K, E256F, E256R, E256N, E256V, E256A, E256T, E256G, E256H, E256I, A257V, A257Q, A257I, A257C, A257P, A257E, L258M, L258I, Y259F, Y259W, Y259H, Y259L, G260A, G260C, K262Q, K262R, W263L, W263F, V264I, V264L, V264M, V264F, F265Y, F265W, F265H, F265S, D267G, L268A, L268I, L268V, H269N, H269Q, H269R, H269L, E270D, E270Q, E270K, L272I, L272F, E273D, E273A, E273G, E273P, W274F, W274Y, W274M, K275R, K275E, K275Q, W276Y, E277K, E277D, E277R, P280K, P280R, I281L, I281V, P282S, P282D, P282N, P282G, P283E, P283D, P283Q, L284I, L284M, L284V, L284C, L284A, L284T, L284S, A285Y, A285C, A285F, A285V, A285S, A285L, R286K, R286Q, R286H, R286E, R286L, R286M, R286V, R286A, P287K, P287D, P287E, P287G, P287Q, P287S, P287R, P287A, E288D, E288L, E288K, E288V, E288Q, F289Y, F289R, F289H, A290G, A290S, A290N, A290C, P291H, V293I, V293L, G294A, G294S, G294P, G294N, G294K, G294R, G294E, G294D, G294Q, G294T, G294H, G294C, G294W, G294M, G294Y, G294V, C295L, C295I, K296R, K296E, K296Q, K296N, K296P, L297I, L297V, G298F, G298A, G298W, G298S, W300F, A301V, A301C, A301G, A301S, A301P, A301I, F303Y, F303W, F303K, V304F, V304L, V304Y, A305V, A305I, A305L, A305T, A305C, L306I, L306V, L306M, L308F, L308I, W309A, W309G, H311Q, H311E, H311R, H311Y, H311N, P312F, P312Y, S313T, S313N, S313G, S313A, W314F, W314L, W314Y, W314I, W314M, W314V, H315Y, L317I, L317M, L317V, L317F, L317C, L317A, L318I, L318V, L318C, L318A, V320I, V320T, V320P, V320L, C321Y, A322L, A322C, A322S, A322G, W323T, V324I, V324L, V324M, C325A, C325G, C325S, T326S, T326V, T326N, I326I, T326P, T326L, G327A, G327N, G327K, S328A, S328T, S328L, S328C, S328V, F329L, F329Y, A332G, A332C, A332S, A332V, A332P, A332T, I336V, I336F, I336L, L337I, L337F, L337M, I340N, I340L, I340V, I340M, I340F, I340T, I342V, I342D, I342L, I342C, V344I, V344L, V344A, V344M, K345G, K345R, K345A, I347V, I347L, G348P, P349D, P349E, D350E, D350N, D350Q, D350G, D350R, D350K, G351A, G351C, G351S, G351P, G351V, K352-, S353-, L354-, P355-, P355D, P355S, R356-, N357S, N357D, N357G, N357E, N358V, I358A, I358L, D359E, D359N, D359P, D359T, W360F, A361G, A361V, A361C, A361S, A361T, R362Q, R362K, R362H, R363H, R363K, R363N, I365V, I365L, T367S, T367N, T367P, T367V, I367A, T367D, G372C, G372A, G372N, G372S, E374D, E374K, E374R, E374N, E374Q, E374H, E374S, E374P, E374A, E374I, E374V, E374G, E374M, E374Y, W375K, W375G, G377A, G377W, H378Y, H378N, H378F, H378Q, H378R, H378M, H378I, H378E, H378W, H378D, H378V, L379I, L379M, L379S, L379V, L379A, L379T, F385W, F385Y, L395M, L395I, L395F, H396S, H396N, H396Y, H396Q, H396E, A398S, A398C, A398G, H399Y, A401S, A401G, A401N, K402T, K402P, K402S, K402R, K402E, K402Q, Q404E, Q404A, Q404R, Q404K, Q404H, Q404P, V406I, V406L, V406M, V406A, V406T, Q408R, Q408H, Q408E, Q408N, Q408M, K409R, K409Q, K409T, K409M, V410I, V410H, V410R, C411I, C411A, C411V, E413D, E413K, E413Q, E413R, E413P, E413N, E413S, E413H, E413A, N414M, N414D, N414L, N414G, N414S, V416I, V416F, V416L, V416Y, N417I, N417R, N417G, K419R, K419G, K419S, H420Y, H420Q, H420R, H420E, H420N, H420P, P422G, P422D, I424V, I424C, G425A, G425L, G425N, G425P, G425D, G429D, G429N, G429S, S430A, S430T, S430C, S430N, M431L, M431I, M431V, M431T, M431F, M431C, L432F, L432I, L432M, S433R, S433K, S433Q, S433A, S433T, S433N, H434Y, H434Q, H434R, H434N, L435I, L435M, L435V, L435F, G436K, G436S, G436P, A437G, A437K, A437P, A437S, L438I, L438M, L438V, G439A, G439N, G439S, G439D, A440S, A440C, A440T, A440V, R441V, R441I, R441L, P442A, P442V, T443V, T443I, T443A, T443G, I443L, W444–, W444Y, W444F, W444S, N445–, A446–, E447D, E447Q, E447K, F448Y, F448W, F448K, M449L, M449I, M449G, A450G, A450E, A450S, A450P, A450D, A450C, G451K, G451R, G451N, G451D, L452P, L452I, L452V, L452A, L452M, E453–, E453D, E453S, E454–, K455–, S456–, S457–, V458–, E459–, C460–, R461–, L462–, R463–, L464–, G465–, A466–, A467–, C468–, A469–, R470–, G471–, C472–, C472S, W473–, W473Q, C474–, C474A, S475–, D476–, A477–, A478–, S479–, L480–, I481–, S482–, W483–, L484–, G485–. Preferably, the amino acid sequence also comprises a motif selected from "KHPGG(SEQ ID NO: 187)", "QHPGG(SEQ ID NO: 188)" or "RHPGG(SEQ ID NO: 189)", preferably a motif selected from "KHPGGD(SEQ ID NO: 190)", "QHPGGD(SEQ ID NO: 191)" or "RHPGGD(SEQ ID NO: 192)", and a motif selected from "GLNIQHDANHG(SEQ ID NO: 193)" or "HVVGHH(SEQ ID NO: 194)", preferably a motif selected from "AAIGLNIQHDANHG(SEQ ID NO: 195)" or "QHVVGHH(SEQ ID NO: 196)".

According to the invention, there is also provided a delta-4 desaturase having the amino acid sequence SEQ ID NO. 86, i.e. matching the sequence in an alignment and not considering mismatches due to the mutations mentioned hereafter, and optionally one or more of the following mutations: H4S, H4Y, H4Q, H4E, H4N, A5S, A5G, A5C, A5P, A5T, A5V, A6R, A6G, A6K, A6S, A6N, T7K, T7S, T7R, T7N, T7A, T7G, K8E, K8D, K8R, K8Q, G9V, G9I, G9A, G9M, G9C, G10S, G10N, G10D, G10A, G10K, D11A, D11V, D11I, D11E, D11G, D11P, P12A, P12G, P12S, P12V, P12T, R15K, R15S, R15T, R15M, R15Q, D16A, D16G, D16P, D16S, M17A, M17L, M17I, M17V, E18K, E18R, E18Q, H19Y, H19F, H19I, H19M, H19L, H19Q, H19R, H19V, F20Y, F20W, F20I, F20A, S21T, S21A, S21C, S21G, S21N, Y22R, Y22F, E23T, E23D, E23N, E23S, R24K, R24E, R24Q, R24D, I25K, I25L, I25V, L26A, L26I, N27D, N27G, N27H, N27S, N27T, N27R, N27K, N27E, N27Q, N27A, N27V, D28H, D28N, D28T, E29T, E29N, E29D, E29Q, E29R, R30N, R30K, R30H, D31P, D31E, D31N, D31S, D32E, D32K, L33I, L33V, L33M, L33F, L33Y, C34T, C34A, C34S, C34V, V36L, V36I, V36M, V36T, G37A, G37D, G37E, G39A, A43S, A43C, A43L, A43R, A43K, T44S, T44V, T44N, T44P, T44K, T44A, A45C, A45N, A45G, D48E, D48N, K49Q, K49R, D54E, D54N, D54H, F55Y, F55W, F55V, F55I, V56L, V56I, V56M, V56A, V56T, D57S, D57N, D57E, L58I, L58F, L58M, G60P, R62Q, R62H, R62D, R62N, P66E, P66D, P66Q, H67G, H67A, H67N, H67S, F69W, F69M, F69Y, E70Q, E70M, E70H, Y71F, Y71W, Y71H, Y71L, R73K, R73Q, R73H, R74H, R74K, R74Q, R74Y, R74N, E75A, E75V, E75Q, E75L, E75P, W76G, W76S, P77D, P77V, P77K, P77A, P77T, P77E, P77Q, P77M, P77L, P78K, P78R, A79S, A79G, A79C, A79T, A79P, A79V, V80I, V80L, V80M, V80R, V80A, V80T, L81M, L81I, L81V, L81F, A82S, A82C, A82G, K83R, K83E, K83Q, K83P, K83N, Y84F, Y84W, K85F, K85G, K85Y, K85L, K85W, L89I, L89V, L89M, D90A, D90E, D90G, D90P, R91K, R91P, R91Q, R91H, R91E, R91A, D92E, D92N, D92S, D93E, D93G, S94K, S94G, S94N, S94P, Y95F, Y95W, Y95H, Y95P, V96I, V96L, Q97H, Q97E, Q97R, Q97N, Q97K, Q97D, Q97Y, H98A, H98Y, H98V, H98I, H98F, H98R, D99E, D99P, D99T, S100P, S100E, S100A, S100D, S100N, S100T, G101L, G101I, G101M, G101A, Y102H, Y102Q, Y102W, Y102M, Y102V, L103C, L103N, L103I, L103V, R104Q, R104K, R104H, R104E, L105I, L105F, C106G, C106A, C106N, C106S, C106K, A107C, A107S, A107G, E108D, E108Q, E108P, E108S, E108K, E108A, N110R, N110D, N110H, G111A, G111K, G111R, G111S, I112L, I112V, L113I, L113M, K115R, K115M, K115Q, K115L, G116W, G116Q, G116N, S117E, S117D, S117N, S117G, G118W, G118A, G118N, W119F, P122A, P122G, W124Y, W125Y, I126L, I126V, C129A, C129G, C129S, L131I, L131V, L131M, L132I, L132V, L132M, V133A, V133I, V133L, V133C, V133M, A135T, A135P, A135S, A135G, L136I, L136V, Y137F, Y137H, Y137W, Y137S, Y137T, L138I, L138V, L138M, L138F, L138T, D139E, D139N, D139Q, Y140W, Y140F, Y140H, Y140G, Y141F, Y141H, Y141L, M142W, M142L, M142I, M142F, L143I, L143V, A144L, A144C, A144G, A144S, R145K, R145S, R145N, R145Q, R145D, P147K, P147E, P147R, I149L, I149V, L150F, L150I, L150M, L150Y, L150W, L150P, A152S, A152G, A152C, A152T, A152P, A152V, I153V, I153L, I154V, I154L, I154F, L155I, L155V, L155M, L155F, L155C, L155A, L155T, L155S, L158I, L158V, F159Y, W161G, W161A, W161C, A174S, A174G, A174C, A174T, A174P, A174V, L175I, L175V, L175M, N178H, N178Y, P179S, V180M, V180A, V180I, V180P, V181I, V181L, V181A, V181T, Y183R, Y183H, Y183W, L184C, L184I, F185L, F185I, A188S, A188G, A188M, A188Q, A188K, S195N, S195G, S195D, S195T, S195A, S195K, M196R, M196L, M196Q, M196I, M197L, M197V, M197I, M197Q, M197C, L200I, L200V, Q201R, Q201E, Q201K, Q202E, Q202K, Q202R, Q202D, Q202H, G206N, G206A, G206S, G206K, G206D, G206W, G206M, L209I, L209F, L209T, T211C, T211S, T211V, T211A, T211N, T211P, D213E, D213N, D213R, D213G, I214V, I214F, I214Y, I214H, D215N, D215Q, D215P, H216Y, H216F, H216Q, H216W, H216R, H216E, H216N, H216M, H216V, H216P, H216I, H216L, H216D, H216A, V220I, V220L, V220M, V220A, V220T, V220Q, G222A, G223H, G223N, G223D, G224S, G224N, G224A, A225V, A225T, A225I, A225G, L226I, L226V, R227K, R227Q, R227N, R227E, R227H, R227T, K229S, K229G, K229A, K229T, P230K, P230D, P230E, P230R, T231V, T231S, T231P, T231N, T231A, T231I, T231Y, D232S, D232G, D232E, G233I, G233L, G233F, G233C, G233M, G233S, W234F, W234Y, W234P, L235M, L235I, L235V, L235F, L235K, P236E, P236D, W237F, H239A, H239S, H239Y, H239G, H239N, L240I, L240V, L243I, L243V, L243M, L243F, L243Y, F245I, F245Y, L248G, L248M, L248A, L248K, L248C, L248F, E249D, E249Q, E249K, E249P, E249R, E249N, E249S, E249V, E249A, E249T, E249G, E249H, E249I, A250V, A250Q, A250L, A250C, A250P, A250E, L251M, L251I, Y252F, Y252W, Y252H, Y252L, G253A, G253C, K255Q, K255R, W256L, W256F, V257I, V257L, V257R, V257F, F258Y, F258W, F258E, F258H, F258S, D260G, L261A, L261I, L261V, H262N, H262Q, H262R, H262L, E263D, E263Q, E263K, L265I, L265F, E266D, E266A, E266G, E266P, W267F, W267Y, W267M, K268R, K268E, K268Q, W269Y, E270K, E270D, E270R, P273K, P273R, I274I, I274V, P275S, P275D, P275N, P275G, P276E, P276D, P276Q, L277I, L277M, L277V, L277C, L277A, L277T, L277S, A278Y, A278C, A278F, A278V, A278S, A278L, R279K, R279Q, R279H, R279E, R279L, R279M, R279V, R279A, P280K, P280D, P280E, P280G, P280S, P280R, P280A, E281D, E281L, E281K, E281V, E281Q, F282Y, F282R, F282H, A283G, A283S, A283N, A283C, P284I, V286I, V286L, G287A, G287S, G287P, G287N, G287K, G287R, G287E, G287D, G287Q, G287T, G287H, G287C, G287W, G287M, G287Y, G287V, C288L, C288I, K289R, K289E, K289Q, K289N, K289P, L290I, L290V, G291F, G291A, G291W, G291S, W293F, A294V, A294C, A294G, A294S, A294P, A294I, F296Y, F296W, F296K, V297I, V297F, V297L, V297Y, A298V, A298I, A298L, A298T, A298C, L299I, L299V, L299M, L301F, L301I, W302A, W302G, H304Q, H304E, H304R, H304Y, H304N, P305F, P305Y, S306T, S306N, S306G, S306A, W307F, W307L, W307Y, W307I, W307M, W307V, H308Y, L310I, L310M, L310V, L310F, L310C, L310A, L311I, L311V, L311C, L311A, V313I, V313T, V313P, V313L, C314Y, A315L, A315C, A315S, A315G, W316T, V317I, V317L, V317M, C318A, C318G, C318S, T319S, T319V, T319N, T319I, T319P, T319L, G320A, G320N, G320K, S321A, S321T, S321L, S321C, S321V, F322L, F322Y, A325G, A325C, A325S, A325V, A325P, A325T, I329V, I329F, I329L, L330I, L330F, L330M, I333N, I333L, I333V, I333M, I333F, I333T, I335V, I335D, I335L, I335C, V337I, V337L, V337A, V337M, K338G, K338R, K338A, I340V, I340L, G341P, P342D, P342E, D343E, D343N, D343Q, D343G, D343R, D343K, G344A, G344C, G344S, G344P, G344V, N345S, N345D, N345G, N345E, I346V, I346A, I346L, D347E, D347N, D347P, D347T, W348F, A349G, A349V, A349C, A349S, A349T, R350Q, R350K, R350H, R351H, R351K, R351N, I353V, I353L, T355S, T355N, T355P, T355V, T355A, T355D, G360C, G360A, G360N, G360S, E362D, E362K, E362R, E362N, E362Q, E362H, E362S, E362P, E362A, E362T, E362V, E362G, E362M, E362Y, W363K, W363G, G365A, G365W, H366Y, H366N, H366F, H366Q, H366R, H366M, H366I, H366E, H366W, H366D, H366V, L367I, L367M, L367S, L367V, L367A, L367T, F373W, F373Y, L383M, L383I, L383F, H384S, H384N, H384Y, H384Q, H384E, A386S, A386C, A386G, H387Y, A389S, A389G, A389N, K390T, K390P, K390S, K390R, K390E, K390Q, Q392E, Q392A, Q392R, Q392K, Q392H, Q392P, V394I, V394L, V394M, V394A, V394T, Q396R, Q396H, Q396E, Q396N, Q396M, K397R, K397Q, K397T, K397M, V398I, V398H, V398R, C399I, C399A, C399V, E401D, E401K, E401Q, E401R, E401P, E401N, E401S, E401H, E401A, N402M, N402D, N402L, N402G, N402S, V404I, V404F, V404L, V404Y, N405K, N405R, N405G, K407R, K407Q, K407S, H408Y, H408Q, H408R, H408N, H408E, H408K, P410G, P410D, I412V, I412C, G413A, G413L, G413N, G413P, G413D, G417D, G417N, G417S, S418A, S418T, S418C, S418N, M419L, M419I, M419V, M419T, M419F, M419C, L420F, L420I, L420M, S421R, S421K, S421Q, S421A, S421T, S421N, H422Y, H422Q, H422N, H422R, L423I, L423M, L423V, L423F, G424K, G424S, G424P, A425G, A425K, A425P, A425S, L426I, L426M, L426V, G427A, G427N, G427S, G427D, A428S, A428C, A428T, A428V, R429V, R429I, R429L, P430A, P430V, T431V, T431I, T431A, T431G, T431L, E432D, E432Q, E432K, F433Y, F433W, F433K, M434L, M434I, M434G, A435G, A435E, A435S, A435P, A435D, A435C, G436K, G436R, G436N, G436D, L437P, L437I, L437V, L437A, L437M. Preferably, the amino acid sequence also comprises
 a motif selected from "KHPGG(SEQ ID NO: 187)", "QHPGG(SEQ ID NO: 188)" or "RHPGG(SEQ ID NO: 189)", preferably a motif selected from "KHPGGD(SEQ ID NO: 190)”, “QHPGGD(SEQ ID NO: 191)” or “RHPGGD(SEQ ID NO: 192)”, and
- a motif selected from “GLNIQHDANHG(SEQ ID NO: 193)” or “HVVGHH(SEQ ID NO: 194)”, preferably a motif selected from “AAIGLNIQHDANHG(SEQ ID NO: 195)” or “QHVVGHH(SEQ ID NO: 196)”.

Particularly preferred is a delta-4 desaturase having the backbone of SEQ ID NO. 86 with optionally one or more of the following mutations: H4S, H4Y, H4Q, H4E, H4N, A5S, A5G, A5C, A5P, A5T, A5V, A6R, A6G, A6K, A6S, A6N, T7K, T7S, T7R, T7N, T7A, T7G, K8E, K8D, K8R, K8Q, G9V, G9I, G9A, G9M, G9C, G10S, G10N, G10D, G10A, G10K, D11A, D11V, D11I, D11E, D11G, D11P, P12A, P12G, P12S, P12V, P12T, R15K, R15S, R15T, R15A, R15Q, D16A, D16G, D16P, D16S, M17A, M17L, M17I, M17V, E18K, E18R, E18Q, H19Y, H19F, H19I, F20Y, F20W, S21T, S21A, S21C, S21G, S21N, Y22R, Y22F, E23T, E23D, E23N, E23S, R24K, R24E, R24Q, R24D, 125K, I25L, I25V, L26A, L26I, N27D, N27G, N27H, N27S, N27T, N27R, D28H, D28N, D28T, E29T, E29N, E29D, E29Q, E29R, R30N, R30K, R30H, D31P, D31E, D31N, D31S, D32E, D32K, L33I, L33V, L33M, L33F, C34T, C34A, C34S, C34V, V36L, V36I, V36M, V36T, G37A, G37D, G37E, G39A, A435, A43C, A43L, A43R, A43K, 144S, 144V, 144N, 144P, 144K, 144A, A45C, A45N, A45G, D48E, D48N, K49Q, K49R, D54E, D54N, D54H, F55Y, F55W, F55V, F55I, V56L, V56I, V56M, V56A, V56T, D57S, D57N, D57E, L58I, L58F, L58M, G60P, R62Q, R62H, R62D, R62N, P66E, P66D, P66Q, H67G, H67A, H67N, H67S, F69W, F69M, F69Y, E70Q, E70M, E70H, Y71F, Y71W, Y71H, Y71L, R73K, R73Q, R73H, R74H, R74K, R74Q, R74Y, R74N, E75A, E75V, E75Q, E75L, E75P, W76G, P77D, P77V, P77K, P78K, P78R, A795, A79G, A79C, A79T, A79P, A79V, V80I, V80L, V80M, V80R, V80A, V80T, L81M, L81I, L81V, L81F, A82S, A82C, A82G, K83R, K83E, K83Q, K83P, K83N, Y84F, Y84W, K85F, K85G, K85Y, K85L, K85W, L89I, L89V, L89M, D90A, D90E, D90G, D90P, R91K, R91P, D92E, D92N, D92S, D93E, D93Q, S94K, 594G, S94N, 594P, Y95F, Y95W, Y95H, V96T, V96I, V96L, Q97H, Q97E, Q97R, Q97N, H98A, H98Y, H98V, H98I, H98F, H98R, D99E, D99P, D99T, S100P, S100E, S100A, S100D, S100N, S100T, G101L, G101I, G101M, G101A, Y102H, Y102Q, Y102W, Y102M, Y102V, L103K, L103M, L103I, L103V, R104Q, R104K, R104H, R104E, L105I, L105F, C106G, C106A, A107C, A107S, A107G, E108D, E108Q, E108P, E108S, N110R, N110D, N110H, G111A, G111K, G111R, G111S, I112L, I112V, L113I, L113M, K115R K115M, K115Q, K115L, G116W, G116Q, G116N, S117E, S117D, S117N, S117G, G118W, G118A, G118N, W119F, P122A, P122G, W124Y, W125Y, I126L, I126V, C129A, C129G, C129S, L131I, L131V, L131M, L132I, L132V, L132M, V133A, V133I, V133L, V133C, V133M, A135T, A135P, A135S, A135G, L136I, L136V, Y137F, Y137H, Y137W, Y137S Y137T, L138I, L138V, D139E, D139N, D139Q, Y140W, Y140F, Y140H, Y141F, Y141H, M142W, M142L, M142I, M142F, L143I, L143V, A144L, A144C, A144G, A144S, R145K, R145S, R145N, R145Q, R145D, P147K, P147E, P147R, I149L, I149V, L150F, L150I, L150M, L150Y, A152S, A152G, A152C, A152T, A152P, A152V, I153V, I153L, I154V, I154L, L155I, L155V, L155M, L155F, L158I, L158V, F159Y, W161G, W161A, W161C, A174S, A174G, A174C, A174T, A174P, A174V, L175I, L175V, L175M, N178H, N178Y, V180M, V180A, V180I, V180P, V181I, V181L, V181A, V181T, Y183R, Y183H, Y183W, L184C, L184I, F185L, F185I, A188S, A188G, A188M, A188Q, A188K, S195N, S195G, S195D, S195T, S195A, S195K, M196R, M196L, M196Q, M196I, M197L, M197V, M197I, M197Q, M197C, L200I, L200V, Q201R, Q201E, Q201K, Q202E, Q202K, Q202R, Q202D, Q202H, G206N, G206A, G2065, G206K, L2091, L209F, L209T, T211C, T211S, T211V, T211A, T211N, T211P, D213E, D213N, D213R, D213G, I214V, I214F, I214Y, D215N, D215Q, D215P, H216Y, V220I, V220L, V220M, V220A, V220T, G223H, G223N, G223D, G224S, G224N, G224A, A225V, A225T, A225I, A225G, L226I, L226V, R227K, R227Q, R227N, R227E, R227H, K229S, K229G, K229A, K229T, P230K, P230D, P230E, P230R, T231V, T231S, T231P, T231N, T231A, D232S, D232G, D232E, G233I, G233L, G233F, W234F, L235M, L235I, P236E, P236D, H239A, H239S, H239Y, H239G, H239N, L240I, L240V, L243I, L243V, L243M, L243F, F245I, F245Y, L248G, L248M, L248A, L248K, L248C, L248F, E249D, E249Q, E249K, A250V, A250Q, A250L, A250C, A250P, A250E, L251M, L251I, Y252F, G253A, G253C, K255Q, K255R, W256L, W256F, V257I, V257L, V257M, V257F, F258Y, D260G, L261A, L261I, L261V, H262N, H262Q, H262R, E263D, E263Q, E263K, L265I, L265F, E266D, E266A, E266G, E266P, W267F, W267Y, K268R, K268E, K268Q, W269Y, E270K, E270D, E270R, P273K, P273R, I274L, I274V, P275S, P275D, P275N, P275G, P276E, P276D, L277I, L277M, L277V, L277C, A278Y, A278C, A278F, A278V, A278S, A278L, R279K, R279Q, P280K, P280D, P280E, E281D, E281L, E281K, E281V, E281Q, F282Y, F282R, F282H, A283G, A283S, A283N, A283C, P284I, V286I, V286L, G287A, G287S, G287P, C288L, C288I, K289R, K289E, K289Q, K289N, K289P, L290I, L290V, G291F, G291A, G291W, G291S, A294V, A294C, A294G, A294S, F296Y, F296W, F296K, V297I, V297F, V297L, V297Y, A298V, A298I, A298L, A298T, A298C, L299I, L299V, L299M, L301F, L301I, W302A, W302G, H304Q, H304E, H304R, H304C, H304N, P305F, P305Y, S306T, S306N, S306G, S306A, W307F, W307L, H308Y, L310I, L310M, L310V, L310F, L311I, L311V, L311C, V313I, V313T, V313P, V313L, C314Y, A315L, A315C, A315S, A315G, W316T, V317I, V317L, C318A, C318G, C318S, T319S, T319V, T319N, I319I, T319P, T319L, G320A, G320N, G320K, S321A, S321T, S321L, S321C, S321V, F322L, F322Y, A325G, A325C, A325S, A325V, A325P, A325T, I329V, I329F, I329L, L330I, L330F, L330M, I333N, I333L, I333V, I333M, I333F, I333T, I335V, I335D, I335L, I335C, V337I, V337L, V337A, V337M, K338G, K338R, K338A, I340V, I340L, P342D, D343E, D343N, D343Q, D343G, G344A, G344C, G344S, G344P, G344V, N345S, N345D, N345G, N345E, I346V, I346A, I346L, D347E, D347N, D347P, D347T, W348F, A349G, A349V, A349C, A349S, A349T, R350Q, R350K, R350H, R351H, R351K, R351N, I353V, I353L, T355S, T355N, T355P, T355V, T355A, T355D, G360C, G360A, G360N, G360S, E362D, E362K, E362R, W363K, W363G, G365A, G365W, H366Y, H366N, H366F, H366Q, H366R, L367I, L367M, L367S, L367V, L367A, L367T, F373W, F373Y, L383M, L383I, L383F, H384S, H384N, H384Y, H384Q, H384E, A386S, A386C, A386G, H387Y, A389S, A389G, A389N, K390T, K390P, K390S, K390R, K390E, Q392E, Q392A, Q392R, Q392K, Q392H, Q392P, V394I, V394L, V394M, V394A, V394T, Q396R, Q396H, Q396E, Q396N, Q396M, K397R, K397Q, K397T, K397M, V398I, V398H, V398R, C399I, C399A, C399V, E401D, E401K, E401Q, E401R, E401P, N402M, N402D, N402L, N402G, N402S, V404I, V404F, V404L, V404Y, N405K, N405R, N405G, K407R, K407G, K407S, H408Y, H408Q, H408R, P410G, P410D, I412V, I412C, G413A, G413L, G413N, G413P, G413D, G417D, G417N, G417S, S418A, S418T, S418C, S418N, M419L, M419I, M419V, M419T, M419F, M419C, L420F, L420I, L420M, S421R, S421K, S421Q, S421A, S421T, S421N, H422Y, H422Q, H422R, L423I, L423M, L423V, L423F, G424K, G424N, G424P, A425G, A425K, A425P, A425S, L426I, L426M, L426V, L427A, L427N, L427S, L427D, A428S, A428C, A428I, A428V, R429V, R429I, R429L, P430A, P430V, T431V, 14311, T431A, T431G, T431L, E432D, E432Q, E432K, F433Y, F433W, F433K, M434L, M434I, M434G, A435G, A435E, A435S, A435P, A435D, A435C, G436K, G436R, G436N, G436D, L437P, L437I, L437V, L437A, L437M. Preferably, the amino acid sequence also comprises a motif selected from "KHPGG(SEQ ID NO: 187)", "QHPGG(SEQ ID NO: 188)" or "RHPGG(SEQ ID NO: 189)", preferably a motif selected from "KHPGGD(SEQ ID NO: 190)", "QHPGGD(SEQ ID NO: 191)" or "RHPGGD(SEQ ID NO: 192)", and a motif selected from "GLNIQHDANHG(SEQ ID NO: 193)" or "HVVGHH(SEQ ID NO: 194)", preferably a motif selected from "AAIGLNIQHDANHG(SEQ ID NO: 195)" or "QHVVGHH(SEQ ID NO: 196)".

Also preferred according to the present invention is a delta-4 desaturase having the backbone of SEQ ID NO. 86 with optionally one or more of the following mutations: H4S, H4Y, A5S, A5G, A6R, A6G, T7K, T7S, T7R, K8E, G9V, G10S, D11A, D11V, P12A, R15K, R15S, D16A, M17A, E18K, S21T, S21A, E23T, R24K, I25K, L26A, N27D, N27G, D28H, E29T, E29N, R30N, D31P, L33I, V36L, A435, A43C, 144S, 144V, 144N, 144P, A45C, D54E, F55Y, V56L, V56I, D57S, L58I, R62Q, H67G, F69W, E70Q, Y71F, R73K, R74H, R74K, E75A, E75V, A795, A79G, V80I, V80L, L81M, A825, K83R, K83E, Y84F, K85F, K85G, L89I, D90A, D90E, S94K, Y95F, V96T, Q97H, H98A, H98Y, D99E, S100P, S100E, S100A, G101L, Y102H, Y102Q, L103K, R104Q, A107E, E108D, N110R, G111A, L113I, K115R, S117E, L131I, L132I, V133A, V133I, A135T, Y137F, Y137H, Y140W, M142W, A144L, R145K, R145S, L150F, A152S, A152G, L155I, A174S, A174G, L175I, V180M, V180A, Y183R, A188S, A188G, S195N, S195G, M196R, M197I, M197V, Q201R, Q202E, Q202K, G206N, L2091, T211C, T211S, D213E, I214V, V220I, V220L, A225V, R227K, R227Q, K229S, K229G, T231V, T231S, G233I, L235M, H239A, L243I, L248G, L248M, E249D, A250V, A250Q, K255Q, V257I, L261A, H262N, E266D, K268R, E270K, P275S, L277I, A278Y, A278C, E281D, E281L, F282Y, A283G, K289R, L290I, G291F, A294V, V297I, A298V, A298I, L299I, H304Q, H304E, S306T, L310I, L311I, V313I, A315L, T319S, T319V, S321A, S321T, A325G, A325C, I329V, I333N, I333I, I335V, V337I, K338G, D343E, G344A, N3455, I346V, D347E, A349G, A349V, T355S, T355N, G360C, E362D, H366Y, L367I, L367M, H3845, H384N, A3865, A3895, K390T, K390P, Q392E, Q392A, V394I, Q396R, K397R, V398I, E401D, E401K, N402M, N402D, V404I, N405K, G413A, S418A, M419L, M419I, L420F, S421R, S421K, S421Q, H422Y, L423I, A425G, L426I, G427A, A428S, R429V, T431V, T431I, F433Y, M434L, A435G, A435E, G436K, L437P, L437I.

Preferably, the amino acid sequence also comprises
a motif selected from "KHPGG(SEQ ID NO: 187)", "QHPGG(SEQ ID NO: 188)" or "RHPGG(SEQ ID NO: 189)", preferably a motif selected from "KHPGGD(SEQ ID NO: 190)", "QHPGGD(SEQ ID NO: 191)" or "RHPGGD(SEQ ID NO: 192)", and
a motif selected from "GLNIQHDANHG(SEQ ID NO: 193)" or "HVVGHH(SEQ ID NO: 194)", preferably a motif selected from "AAIGLNIQHDANHG(SEQ ID NO: 195)" or "QHVVGHH(SEQ ID NO: 196)".

Even more preferably the delta-4 desaturase of the present invention has the backbone of SEQ ID NO. 86 with optionally one or more of the following mutations: H4S, A5S, A6R, T7K, T7S, K8E, K8D, G9V, G105, D11A, D11V, P12A, R15S, D16A, M17A, E18K, S21T, Y22R, E23T, R24E, I25K, L26A, D28H, D28T, E29T, R30N, D31P, D31S, D32K, C341, V36L, G37E, G39A, A43L, 144K, A45N, D48E, D54H, F55V, V56L, D57S, L58F, G60P, R62Q, P66E, H67A, E70M, Y71L, R73Q, R74Y, E75A, P78K, A795, V80R, L81M, A825, K83E, Y84F, K85F, L89V, D90A, R91P, D92S, D93E, S94K, V96T, H98A, H98V, D99T, S100P, S100E, G101L, G101A, Y102M, L103K, R104Q, L105I, A107S, N110R, G111A, G111K, L113M, K115M, G116Q, S117E, G118W, W119F, P122A, W124Y, W125Y, I126L, C129A, L131I, L132I, L132V, V133A, A135T, L136V, Y137S, Y137T, L138I, D139E, M142W, L143I, A144L, R145S, P147K, I149L, L150F, A152S, I153V, L158V, F159Y, W161A, A174S, L175V, N178H, N178Y, V180M, V180A, V181I, Y183R, L184C, F185L, A188S, A188M, S195N, M196R, M197V, L200I, Q201R, Q202E, L209T, T211C, D213R, D215Q, G223H, G224S, A225V, L226I, K229S, P230R, D232S, G233L, L235M, P236E, H239A, H239S, L240I, L243V, F245I, L248G, A250Q, L251M, G253A, K255Q, W256L, V257L, D260G, L261A, E263D, L265I, E266A, K268R, W269Y, E270K, P273K, I274L, P275S, P276E, A278Y, P280K, E281L, F282Y, F282R, A283N, P284I, V286I, G287A, C288L, K289R, L290V, G291F, G291A, F296K, V297F, A298V, L299V, L301F, W302A, H304Q, P305F, S306T, W307L, H308Y, C314Y, A315L, W316T, C318A, T319I, G320A, S321A, F322L, A325G, I329F, L330I, I333N, V337A, K338G, K338A, D343Q, G344A, N3455, I346A, D3471, W348F, A349V, A3491, R350Q, R351H, I353V, T355S, G360C, E362K, W363K, G365A, L3675, F373Y, L383M, H3845, A3865, H387Y, A3895, K390T, Q392A, V394L, Q396R, K397Q, K397T, V398H, V398R, C399I, E401K, N402M, N402L, V404F, V404Y, N405K, K407R, K4075, P410G, I412V, G413L, G417D, G4175, S418A, M419T, L420F, L420M, S421R, S421Q, H422Q, L423M, L423V, G424K, A425K, L426M, G427A, A428S, A4281, R429V, P430A, T431V, T431G, E432D, F433K, M434L, M434G, A435G, A435E, G436K, G436R, L437P, L437A. Preferably, the amino acid sequence also comprises

- a motif selected from "KHPGG(SEQ ID NO: 187)", "QHPGG(SEQ ID NO: 188)" or "RHPGG(SEQ ID NO: 189)", preferably a motif selected from "KHPGGD(SEQ ID NO: 190)", "QHPGGD(SEQ ID NO: 191)" or "RHPGGD(SEQ ID NO: 192)", and
- a motif selected from "GLNIQHDANHG(SEQ ID NO: 193)" or "HVVGHH(SEQ ID NO: 194)", preferably a motif selected from "AAIGLNIQHDANHG(SEQ ID NO: 195)" or "QHVVGHH(SEQ ID NO: 196)".

And even more preferably the delta-4 desaturase of the present invention has the backbone of SEQ ID NO. 86 with one or more of the following mutations: H4S, A5S, A6R, T7K, T7S, K8E, G9V, G10S, D11A, D11V, P12A, R15S, D16A, M17A, E18K, S21T, E23T, I25K, L26A, D28H, E29T, R30N, D31P, V36L, V56L, D57S, R62Q, E75A, A79S, L81M, A82S, K83E, Y84F, K85F, D90A, S94K, V96T, H98A, S100P, S100E, G101L, L103K, R104Q, N110R, G111A, S117E, L131I, L132I, V133A, A135T, M142W, A144L, R145S, L150F, A152S, A174S, V180M, V180A, Y183R, A188S, S195N, M196R, M197V, Q201R, Q202E, T211C, A225V, K229S, L235M, H239A, L248G, A250Q, K255Q, L261A, K268R, E270K, P275S, A278Y, E281L, F282Y, K289R, G291F, A298V, H304Q, S306T, A315L, S321A, A325G, I333N, K338G, G344A, N345S, A349V, T355S, G360C, H384S, A386S, A389S, K390T, Q392A, Q396R, E401K, N402M, N405K, S418A, L420F, S421R, S421Q, G427A, A428S, R429V, T431V, M434L, A435G, A435E, G436K, L437P. Preferably, the amino acid sequence also comprises

- a motif selected from "KHPGG(SEQ ID NO: 187)", "QHPGG(SEQ ID NO: 188)" or "RHPGG(SEQ ID NO: 189)", preferably a motif selected from "KHPGGD(SEQ ID NO: 190)", "QHPGGD(SEQ ID NO: 191)" or "RHPGGD(SEQ ID NO: 192)", and
- a motif selected from "GLNIQHDANHG(SEQ ID NO: 193)" or "HVVGHH(SEQ ID NO: 194)", preferably a motif selected from "AAIGLNIQHDANHG(SEQ ID NO: 195)" or "QHVVGHH(SEQ ID NO: 196)".

It is understood that mutations are preferably chosen to increase the sequence identity between the mutated sequence and the sequence of SEQ ID NO. 79. This way, the danger of exceptionally preparing a non-functional mutant is decreased.

Thus, it is also preferred that the delta-4 desaturase of the present invention has the backbone of SEQ ID NO. 79, preferably with one or more of the following mutations: V9-, V10G, S11G, D12-, S13-, L20-, K21-, E29R, K37D, E42G, F63L, F63I, L76Y, L76F, L76W, Q78R, Y79R, S81W, L82P, S84A, E88K, Y89F, V94L, V94I, T104D, Q109R, K111C, A113E, R115N, W123G, W124F, W129Y, Y130W, I136L, L1371, D144E, Y145W, Y145F, W147M, I158V, 5160L, Y164F, S179A, I205L, C216T, R218D, S229G, T232R, R235P, P239W, E241P, F242W, V262I, V262L, D268E, M272W, Y274W, K278P, L279I, K285P, I289P, I291V, R294K, V295L, V295I, F298W, V304L, V304I, H309Q, F310P, Y313H, A323C, A325G, L327F, G330A, A342V, A342I, P346G, E347P, A349G, K350-, W354F, S361T, C366G, K369W, I372H, Y379F, K414H, G416P, D423G, T425M, F426L, Q428H, V429L, V429I, A436P, Y438-, N439-, E440D. Among these mutations, the following are more preferred: V9-, V10G, S11G, D12-, S13-, L20-, K21-, E29R, F63L, L76Y, L76f, S81W, L82P, Y89F, V94L, T104D, K111C, W123G, W124F, Y130W, I136L, Y164F, R218D, S229G, T232R, R235P, P239W, E241P, F242W, V262i, M272W, Y274W, K285P, F298W, V304L, A325G, L327F, E347P, K350-, C366G, K369W, I372H, K414H, G416P, Q428H, V429L, A436P, Y438-, N439-. Even more preferred are the following mutations: V9-, D12-, S13-, L20-, K21-, L82P, W123G, Y130W, R235P, P239W, E241P, M272W, Y274W, K285P, F298W, K350-, C366G, G416P, Y438-, N439-. The 10 most preferred mutations of SEQ ID NO. 79 individually or in combination still leading to a delta-4 desaturase of high efficiency when combined with a delta-5 elongase are V9-, D12-, S13-, L20-, K21-, Y130W, R235P, K350-, Y438-, N439-. In these lists, "-" denotes a deletion.

The invention also provides a method for screening for delta-4 desaturase genes, comprising the steps of a) extracting genetic material of an organism belonging to the taxonomic ranks of Ichthyosporea or Haptophyceae, preferably to the order of Ichthyophonida or Pavlovales, more preferably of genus *Anurofeca, Creolimax, Ichthyophonus, Pseudoperkinsus, Psorospermium* or *Sphaeroforma,*
b) hybridizing to the genetic material a nucleic acid coding for at least 10, preferably at least 20 consecutive amino acids of the delta-4 desaturase of the present invention as defined above or below under stringent conditions, and
c) detecting hybridization or lack of hybridization.

Hybridization indicates that the organism the genetic material of which is provided in step a) does comprise a gene for a delta-4 desaturase.

Particularly preferred is to detect hybridization or lack of hybridization by a nucleic acid amplification reaction. Such reaction will only provide significant products if a probe has hybridized to the genetic material serving as template for the amplification reaction. Thus, the invention also provides a method for screening for delta-4 desaturase genes, comprising the steps of
a) extracting genetic material of an organism belonging to the taxonomic ranks of Ichthyosporea or Haptophyceae, preferably to the order of Ichthyophonida or Pavlovales, more preferably of genus *Anurofeca, Creolimax, Ichthyophonus, Pseudoperkinsus, Psorospermium* or *Sphaeroforma*,
b) providing the reactants for a nucleic acid amplification reaction for amplifying a nucleic acid coding for at least 10, preferably at least 20 consecutive amino acids of the delta-4 desaturase of the present invention as defined above or below under stringent conditions, and
c) detecting amplification or lack of amplification.

Amplification indicates that the organism the genetic material of which is provided in step a) does comprise a gene for a delta-4 desaturase.

The nucleic acid used for hybridization or the reactants used for nucleic acid amplification, particularly for a polymerase chain reaction, are preferably directed to a nucleic acid section coding for a conserved amino acid motif, wherein the motif preferably comprises
    a motif selected from "KHPGG(SEQ ID NO: 187)", "QHPGG(SEQ ID NO: 188)" or "RHPGG(SEQ ID NO: 189)", preferably a motif selected from "KHPGGD(SEQ ID NO: 190)", "QHPGGD(SEQ ID NO: 191)" or "RHPGGD(SEQ ID NO: 192)", and
    a motif selected from "GLNIQHDXNHG(SEQ ID NO: 234)" or "HVVGHH(SEQ ID NO: 194)", preferably a motif selected from "AAIGLNIQHDANHG(SEQ ID NO: 195)" or "QHVVGHH(SEQ ID NO: 196)".

Suitable primers for a polymerase chain reaction are described below.

Thus, the present invention also relates to a polynucleotide comprising a nucleic acid sequence elected from the group consisting of:
a) a nucleic acid sequence having a nucleotide sequence as shown in SEQ ID NOs: 1, 4, 7, 10, 13, 16, 19, 22, 25, 28, 31, 78 or 83
b) a nucleic acid sequence encoding a polypeptide having an amino acid sequence as shown in SEQ ID NOs: 2, 5, 8, 11, 14, 17, 20, 23, 26, 29, 32, 79, 84, 85 or 86, or a delta-4 desaturase as described above,
c) a nucleic acid sequence being at least 70% identical to the nucleic acid sequence of a) or b), wherein said nucleic acid sequence encodes a polypeptide having desaturase, keto-acyl-CoA synthase (KCS) or keto-acyl-CoA reductase (KCR) or lysophospholipid-coenzyme A synthase (LACS) activity
d) a nucleic acid sequence encoding a polypeptide having desaturase, keto-acyl-CoA synthase (KCS), keto-acyl-CoA reductase (KCR) or lysophospholipid-coenzyme A synthase (LACS) activity and having an amino acid sequence which is at least 60% identical to the amino acid sequence of any one of a) to c); and
e) a nucleic acid sequence which is capable of hybridizing under stringent conditions to any one of a) to d), wherein said nucleic acid sequence encodes a polypeptide having desaturase, keto-acyl-CoA synthase (KCS), keto-acyl-CoA reductase (KCR) or lysophospholipid-coenzyme A synthase (LACS) activity.

The term "polynucleotide" as used in accordance with the present invention relates to a polynucleotide comprising a nucleic acid sequence which encodes a polypeptide having desaturase, keto-acyl-CoA-synthase, keto-acyl-CoA-reductase or lysophospholipid-coenzyme A synthase activity.

Preferably, the polypeptide encoded by the polynucleotide of the present invention having desaturase, KCS, KCR or LACS activity, respectively, upon expression in a plant shall be capable of increasing the amount of PUFA and, in particular, LCPUFA in, e.g., seed oils or the entire plant or parts thereof. Such an increase is, preferably, statistically significant when compared to a LCPUFA producing transgenic control plant which expresses the minimal set of desaturases and elongases required for LCPUFA synthesis but does not express the polynucleotide of the present invention. Whether an increase is significant can be determined by statistical tests well known in the art including, e.g., Student's t-test. More preferably, the increase is an increase of the amount of triglycerides containing LCPUFA of at least 5%, at least 10%, at least 15%, at least 20% or at least 30% compared to said control. Preferably, the LCPUFA referred to before is a polyunsaturated fatty acid having a C-20, C-22 or C-24 fatty acid body, more preferably, ARA, EPA or DHA. Suitable assays for measuring the activities mentioned before are described in the accompanying Examples.

The term "acyltransferase activity" or "acyltransferase" as used herein encompasses all enymatic activities and enzymes which are capable of transferring or are involved in the transfer of PUFA and, in particular; LCPUFA from the acly-CoA pool or the membrane phospholipis to the triglycerides, from the acyl-CoA pool to membrane lipids and from membrane lipids to the acyl-CoA pool by a transesterification process. It will be understood that this acyltransferase activity will result in an increase of the LCPUFA esterified to triglycerides in, e.g., seed oils. In particular, it is envisaged that these acyl-transferases are capable of producing triglycerides having esterified EPA or even DHA, or that these acyltransferases are capable of enhancing synthesis of desired PUFA by increasing the flux for specific intermediates of the desired PUFA between the acyl-CoA pool (the site of elongation) and membrane lipids (the predominant site of desatu-ration). Specifically, acyltransferase activity as used herein relates to lysophospholipid acyltransferase (LPLAT) activity, preferably, lysophosphatidylcholine acyltransferase (LPCAT) or Lysophosphophatidylethanolamine acyltransferase (LPEAT) activity, lyso-phosphatidic acid acyltransferase (LPAAT) activity, glycerol-3-phosphate acyl-transferase (GPAT) activity or diacylglycerol acyltransferase (DGAT), and, more pref-erably, to LPLAT, LPAAT, DGAT or GPAT activity.

The term "desaturase" encompasses all enymatic activities and enzymes catalyzing the desaturation of fatty acids with different lengths and numbers of unsaturated carbon atom double bonds. Specifically this includes delta 4 (d4)-desaturase, catalyzing the dehydrogenation of the 4th and 5th carbon atom. Delta 5 (d5)-desaturase catalyzing the dehydrogenation of the 5th and 6th carbon atom. Delta 6 (d6)-desaturase catalyzing the dehydrogenation of the 6th and 7th carbon atom. Delta 8 (d8)-desaturase catalyzing the dehydrogenation of the 8th and 9th carbon atom. Delta 9 (d9)-desaturase catalyzing the dehydrogenation of the 9th and 10th carbon atom. Delta 12 (d12)-desaturase catalyzing the dehydrogenation of the 12th and 13th carbon atom. Delta 15 (d15)-desaturase catalyzing the dehydrogenation of the 15th and 16th carbon atom. It is understood that fatty acids can be bound to the acyl-carrier protein (ACP), to coenzyme A (CoA) or in phospholipids, thereby forming different pools. Desaturases generally exhibit a preference for one of these pools.

The terms "elongase" and "d5Elo, d6Elo or d9Elo" are synonymous to KCS and refer to keto-acyl-CoA-synthase enzymatic activity, which allows to introduce two carbon atoms in a fatty acid whereby the fatty acid is elongated. Specifically, d5Elo, d6Elo or d9Elo catalyzes the introduction of two carbon atoms into fatty acids having 18 or 20 carbon atoms and double bonds in the positions 5, 6, or 9, respectively.

The term "KCR" as used herein refer to keto-acyl-CoA-reductase activity, which reduces the keto-group of keto-acyl-CoA to a hydroxyl-group, in the process of fatty acid elongation.

The term "DH" as used herein refers to dehydratase activity, removing the hydroxyl-group leading to the formation of a acyl-2-en-CoA ester (delta-2-enoyl-CoA) and $H_2O$ during fatty acid elongation.

The term "ECR" as used herein refers to enoyl-CoA reductase activity, reducing the double bond of delta-2-enoyl-CoA, in course of fatty acid elongation, generating the elongated acyl-CoA ester.

Fatty acid elongation is catalyzed in four steps, represented by four enzymes: KCS (keto-acyl-CoA-synthase), KCR (keto-acyl-CoA-reductase), DH (dehydratase) and ECR (enoyl-CoA-reductase). In the first step a fatty acid-CoA ester is condensed with malonyl-CoA producing a keto-acly-CoA intermediate, which is elongated by two carbon atoms, and $CO_2$. The keto-group of the intermediate is then reduced by the KCR to a hydroxyl-group. In the next step the DH cleaves of the hydroxyl-group ($H_2O$ is produced), forming a acyl-2-en-CoA ester (delta-2-enoyl-CoA). In the final step the double bound at position 2, 3 is reduced by the ECR forming the elongated acyl-CoA ester (Buchanan, Gruissem, Jones (2000) Biochemistry & Molecular biology of plants, American Society of Plant Physiologists).

In the studies underlying this invention, enzymes with superior desaturase, KCS KCR, DH, and ECR catalytic activities for the production of PUFA has been provided.

More preferably, polynucleotides having a nucleic acid sequence as shown in SEQ ID NOs: 1 encoding polypeptides having amino acid sequences as shown in SEQ ID NOs: 2 or variants thereof, preferably, exhibit d6-desaturase activity.

Polynucleotides having a nucleic acid sequence as shown in SEQ ID NOs: 4 encoding polypeptides having amino acid sequences as shown in SEQ ID NOs: 5 or variants thereof, preferably, exhibit d9-desaturase activity.

Polynucleotides having a nucleic acid sequence as shown in SEQ ID NOs: 7 and 10 encoding polypeptides having amino acid sequences as shown in SEQ ID NOs: 8 and 11 or variants thereof, preferably, exhibit o3-desaturase activity.

Polynucleotides having a nucleic acid sequence as shown in SEQ ID NOs: 13 encoding polypeptides having amino acid sequences as shown in SEQ ID NOs: 14 or variants thereof, preferably, exhibit d12-desaturase activity.

Polynucleotides having a nucleic acid sequence as shown in SEQ ID NOs: 78 encoding polypeptides having amino acid sequences as shown in SEQ ID NOs: 79 or variants thereof, preferably, exhibit d4-desaturase activity. Further preferred delta-4 desaturase polypeptide sequences have been described supra in detail.

Polynucleotides having a nucleic acid sequence as shown in SEQ ID NO. 83 encoding polypeptides having amino acid sequences as shown in SEQ ID NO. 84 or variants thereof, preferably, exhibit lysophospholipid-coenzyme A synthase activity.

Polynucleotides having a nucleic acid sequence as shown in SEQ ID NOs: 16, 19, 22, 25 or 28 encoding polypeptides having amino acid sequences as shown in SEQ ID NOs: 17, 20, 23, 26 or 29 or variants thereof, preferably, exhibit keto-acyl-CoA synthase activity. Specifically, SEQ ID NO. 16 encoding polypeptide SEQ ID NO 17 exhibits d5-elongase activity; SEQ ID NO. 19, 22 and 25 encoding polypeptide SEQ ID NO 20, 23 and 26, respectively, exhibits d6-elongase activity; SEQ ID NO. 28, encoding polypeptide SEQ ID NO 29 exhibits d9-elongase activity.

Polynucleotides having a nucleic acid sequence as shown in SEQ ID NOs: 31 encoding polypeptides having amino acid sequences as shown in SEQ ID NOs: 32 or variants thereof, preferably, exhibit keto-acyl-CoA reductase activity.

A polynucleotide encoding a polypeptide having a desaturase, KCS, KCR and LACS activity as specified above has been obtained in accordance with the present invention, preferably, from *Thraustochytrium aureum* and *Sphaeroforma arctica*. However, orthologs, paralogs or other homologs may be identified from other species. Preferably, they are obtained from plants such as algae, for example *Isochrysis, Mantoniella, Ostreococcus* or *Crypthecodinium*, algae/diatoms such as *Phaeodactylum, Thalassiosira* or *Thraustochytrium*, choanoflagellates such as *Monosiga*, mosses such as *Physcomitrella* or *Ceratodon*, or higher plants such as the Primulaceae such as *Aleuritia, Calendula stellata, Osteospermum spinescens* or *Osteospermum hyoseroides*, microorganisms such as fungi, such as *Aspergillus, Phytophthora, Entomophthora, Mucor* or *Mortierella*, bacteria such as *Shewanella*, yeasts or animals. Preferred animals are nematodes such as *Caenorhabditis*, insects or vertebrates. Among the vertebrates, the nucleic acid molecules may, preferably, be derived from Euteleostomi, Actinopterygii; Neopterygii; Teleostei; Euteleostei, Protacanthopterygii, Salmoniformes; Salmonidae or *Oncorhynchus*, more preferably, from the order of the Salmoniformes, most preferably, the family of the Salmonidae, such as the genus *Salmo*, for example from the genera and species *Oncorhynchus mykiss, Trutta trutta* or *Salmo trutta fario*. Moreover, the nucleic acid molecules may be obtained from the diatoms such as the genera *Thalassiosira* or *Phaeodactylum*.

Thus, the term "polynucleotide" as used in accordance with the present invention further encompasses variants of the aforementioned specific polynucleotides representing orthologs, paralogs or other homologs of the polynucleotide of the present invention. Moreover, variants of the polynucleotide of the present invention also include artificially generated muteins. Said muteins include, e.g., enzymes which are generated by mutagenesis techniques and which exhibit improved or altered substrate specificity, or codon optimized polynucleotides. The polynucleotide variants, preferably, comprise a nucleic acid sequence characterized in that the sequence can be derived from the aforementioned specific nucleic acid sequences shown in any one of SEQ ID NOs: 1, 4, 7, 10, 13, 16, 19, 22, 25, 28, 31, 78 or 83 by a polynucleotide encoding a polypeptide having an amino acid sequence as shown in any one of SEQ ID NOs: 2, 5, 8, 11, 14, 17, 20, 23, 26, 29, 32, 79, 84, 85 or 86 by at least one nucleotide substitution, addition and/or deletion, whereby the variant nucleic acid sequence shall still encode a polypeptide having a desaturase, KCS, KCR and LACS activity as specified above. Variants also encompass polynucleotides comprising a nucleic acid sequence which is capable of hybridizing to the aforementioned specific nucleic acid sequences, preferably, under stringent hybridization conditions. These stringent conditions are known to the skilled worker and can be found in Current Protocols in Molecular Biology, John Wiley & Sons, N. Y. (1989), 6.3.1-6.3.6. A preferred example for stringent hybridization conditions are hybridization conditions in 6× sodium chloride/sodium cit-rate (=SSC) at approximately 45° C., followed by one or more wash steps in 0.2×SSC, 0.1% SDS at 50 to 65° C. The skilled worker knows that these hybridization conditions differ depending on the type of nucleic acid and, for example when organic solvents are present, with regard to the temperature and concentration of the buffer. For example, under "standard hybridization conditions" the temperature differs depending on the type of nucleic acid between 42° C. and 58° C. in aqueous buffer with a concentration of 0.1 to 5×SSC (pH 7.2). If organic solvent is present in the abovementioned buffer, for example 50% formamide, the temperature under standard conditions is approximately 42° C. The hybridization conditions for DNA: DNA hybrids are, preferably, 0.1×SSC and 20° C. to 45° C., preferably between 30° C. and 45° C. The hybridization conditions for DNA:RNA hybrids are, preferably, 0.1×SSC and 30° C. to 55° C., preferably between 45° C. and 55° C. The abovementioned hybridization temperatures are determined for example for a nucleic acid with approximately 100 bp (=base pairs) in length and a G+C content of 50% in the absence of formamide. The skilled worker knows how to determine the hybridization conditions required by referring to textbooks such as the textbook mentioned above, or the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford. Alternatively, polynucleotide variants are obtainable by PCR-based techniques such as mixed oligonucleotide primer-based amplification of DNA, i.e. using degenerated primers against conserved domains of the polypeptides of the present invention. Conserved domains of the polypeptide of the present invention may be identified by a sequence comparison of the nucleic acid sequences of the polynucleotides or the amino acid sequences of the polypeptides of the present invention. Oligonucleotides suitable as PCR primers as well as suitable PCR conditions are described in the accompanying Examples. As a template, DNA or cDNA from bacteria, fungi, plants or animals may be used. Further, variants include polynucleotides comprising nucleic acid sequences which are at least 50%, at least 55%, at least 60%, at least 65%, at least 70%, at least 75%, at least 80%, at least 85%, at least 90%, at least 95%, at least 98% or at least 99% identical to the nucleic acid sequences shown in any one of SEQ ID NOs: 1, 4, 7, 10, 13, 16, 19, 22, 25, 28, 31, 78 or 83 preferably, encoding polypeptides retaining desaturase, KCS, KCR and LACS activity as specified above. Moreover, also encompassed are polynucleotides which comprise nucleic acid sequences encoding a polypeptide having an amino acid sequences which are at least 50%, at least 55%, at least 60%, at least 65%, at least 70%, at least 75%, at least 80%, at least 85%, at least 90%, at least 95%, at least 98% or at least 99% identical to the amino acid sequences shown in any one of SEQ ID NOs: 2, 5, 8, 11, 14, 17, 20, 23, 26, 29, 32, 79, 84, 85 or 86 wherein the polypeptide, preferably, retains desaturase, KCS, KCR and LACS as specified above. The percent identity values are, preferably, calculated over the entire amino acid or nucleic acid sequence region. A series of programs based on a variety of algorithms is available to the skilled worker for comparing different sequences. In a preferred embodiment, the percent identity between two amino acid sequences is determined using the Needleman and Wunsch algorithm (Needleman 1970, J. Mol. Biol. (48):444-453) which has been incorporated into the needle program in the EMBOSS software package (*EMBOSS: The European Molecular Biology Open Software Suite*, Rice, P., Longden, I., and Bleasby, A, Trends in Genetics 16(6), 276-277, 2000), using either a BLOSUM 45 or PAM250 scoring matrix for distantly related proteins, or either a BLOSUM 62 or PAM160 scoring matrix for closer related proteins, and a gap opening penalty of 16, 14, 12, 10, 8, 6, or 4 and a gap entension pentalty of 0.5, 1, 2, 3, 4, 5, or 6. Guides for local installation of the EMBOSS package as well as links to WEB-Services can be found at http://emboss.sourceforge.net. A preferred, non-limiting example of parameters to be used for aligning two amino acid sequences using the needle program are the default parameters, including the EBLOSUM62 scoring matrix, a gap opening penalty of 10 and a gap extension penalty of 0.5. In yet another preferred embodiment, the percent identity between two nucleotide sequences is determined using the needle program in the EMBOSS software package (*EMBOSS: The European Molecular Biology Open Software Suite*, Rice, P., Longden, I., and Bleasby, A, Trends in Genetics 16(6), 276-277, 2000), using the EDNAFULL scoring matrix and a gap opening penalty of 16, 14, 12, 10, 8, 6, or 4 and a gap extension penalty of 0.5, 1, 2, 3, 4, 5, or 6. A preferred, non-limiting example of parameters to be used in conjunction for aligning two nucleic acid sequences using the needle program are the default parameters, including the EDNAFULL scoring matrix, a gap opening penalty of 10 and a gap extension penalty of 0.5. The nucleic acid and protein sequences of the present invention can further be used as a "query sequence" to perform a search against public databases to, for example, identify other family members or related sequences. Such searches can be performed using the BLAST series of programs (version 2.2) of Altschul et al. (Altschul 1990, J. Mol. Biol. 215:403-10). BLAST using desaturase, KCS, KCR and LACS nucleic acid sequences of the invention as query sequence can be performed with the BLASTn, BLASTx or the tBLASTx program using default parameters to obtain either nucleotide sequences (BLASTn, tBLASTx) or amino acid sequences (BLASTx) homologous to desaturase, KCS, KCR and LACS sequences of the invention. BLAST using desaturase, KCS, KCR and LACS protein sequences of the invention as query sequence can be performed with the BLASTp or the tBLASTn program using default parameters to obtain either amino acid sequences (BLASTp) or nucleic acid sequences (tBLASTn) homologous to desaturase, KCS, KCR and LACS sequences of the invention. To obtain gapped alignments for comparison purposes, Gapped BLAST using default parameters can be utilized as described in Altschul et al. (Altschul 1997, Nucleic Acids Res. 25(17):3389-3402).

TABLE 1

Relation of sequence types: DNA or PRT (Protein) of query- and hit-sequences for various BLAST programs

| Input query sequence | Converted Query | Algorithm | Converted Hit | Actual Database |
|---|---|---|---|---|
| DNA | | BLASTn | | DNA |
| PRT | | BLASTp | | PRT |
| DNA | PRT | BLASTx | | PRT |
| PRT | | tBLASTn | PRT | DNA |
| DNA | PRT | tBLASTx | PRT | DNA |

A polynucleotide comprising a fragment of any of the aforementioned nucleic acid sequences is also encompassed as a polynucleotide of the present invention. The fragments shall encode polypeptides which still have desaturase, KCS, KCR or LACS activity as specified above. Accordingly, the polypeptide may comprise or consist of the domains of the polypeptide of the present invention conferring the said biological activity. A fragment as meant herein, preferably, comprises at least 50, at least 100, at least 250 or at least 500 consecutive nucleotides of any one of the aforementioned nucleic acid sequences or encodes an amino acid sequence comprising at least 20, at least 30, at least 50, at least 80, at least 100 or at least 150 consecutive amino acids of any one of the aforementioned amino acid sequences.

The variant polynucleotides or fragments referred to above, preferably, encode polypeptides retaining desaturase, KCS, KCR or LACS activity to a significant extent, preferably, at least 10%, at least 20%, at least 30%, at least 40%, at least 50%, at least 60%, at least 70%, at least 80% or at least 90% of the desaturase, KCS, KCR or LACS activity exhibited by any of the polypeptide shown in any one of SEQ ID NOs: 2, 5, 8, 11, 14, 17, 20, 23, 26, 29, 32, 79, 84, 85 or 86. The activity may be tested as described in the accompanying Examples.

The polynucleotides of the present invention either essentially consist of the aforementioned nucleic acid sequences or comprise the aforementioned nucleic acid sequences. Thus, they may contain further nucleic acid sequences as well. Preferably, the polynucleotide of the present invention may comprise in addition to an open reading frame further untranslated sequence at the 3' and at the 5' terminus of the coding gene region: at least 500, preferably 200, more preferably 100 nucleotides of the sequence upstream of the 5' terminus of the coding region and at least 100, preferably 50, more preferably 20 nucleotides of the sequence downstream of the 3' terminus of the coding gene region. Furthermore, the polynucleotides of the present invention may encode fusion proteins wherein one partner of the fusion protein is a polypeptide being encoded by a nucleic acid sequence recited above. Such fusion proteins may comprise as additional part other enzymes of the fatty acid or PUFA biosynthesis pathways, polypeptides for monitoring expression (e.g., green, yellow, blue or red fluorescent proteins, alkaline phosphatase and the like) or so called "tags" which may serve as a detectable marker or as an auxiliary measure for purification purposes. Tags for the different purposes are well known in the art and comprise FLAG-tags, 6-histidine-tags, MYC-tags and the like.

The polynucleotide of the present invention shall be provided, preferably, either as an isolated polynucleotide (i.e. purified or at least isolated from its natural context such as its natural gene locus) or in genetically modified or exogenously (i.e. artificially) manipulated form. An isolated polynucleotide can, for example, comprise less than approximately 5 kb, 4 kb, 3 kb, 2 kb, 1 kb, 0.5 kb or 0.1 kb of nucleotide sequences which naturally flank the nucleic acid molecule in the genomic DNA of the cell from which the nucleic acid is derived. The polynucleotide, preferably, is provided in the form of double or single stranded molecule. It will be understood that the present invention by referring to any of the aforementioned polynucleotides of the invention also refers to complementary or reverse complementary strands of the specific sequences or variants thereof referred to before. The polynucleotide encompasses DNA, including cDNA and genomic DNA, or RNA polynucleotides.

However, the present invention also pertains to polynucleotide variants which are derived from the polynucleotides of the present invention and are capable of interfering with the transcription or translation of the polynucleotides of the present invention. Such variant polynucleotides include antisense nucleic acids, ribozymes, siRNA molecules, morpholino nucleic acids (phosphorodiamidate morpholino oligos), triple-helix forming oligonucleotides, inhibitory oligonucleotides, or micro RNA molecules all of which shall specifically recognize the polynucleotide of the invention due to the presence of complementary or substantially complementary sequences. These techniques are well known to the skilled artisan. Suitable variant polynucleotides of the aforementioned kind can be readily designed based on the structure of the polynucleotides of this invention.

Moreover, comprised are also chemically modified polynucleotides including naturally occurring modified polynucleotides such as glycosylated or methylated polynucleotides or artificial modified ones such as biotinylated polynucleotides.

In the studies underlying the present invention, advantageously, polynucleotides where identified encoding desaturases, keto-acyl-CoA-synthases, keto-acyl-CoA-reductases and lysophospholipid-coenzyme A synthase from *Thraustochytrium aureum* and *Sphaeroforma arctica*. In particular, the *Thraustochytrium aureum* d6-desaturase (pd6Des(Ta)_c3318), d9-desaturase (pd9Des(Ta)_c4008), o3-desaturase (po3Des(Ta)_c959, po3Des(Ta)_c1830), d12-desaturase (pd12Des(Ta)_c1219) keto-acyl-CoA-synthase (pd5Elo (Ta)_c1, pd6Elo(Ta)_c231, pd6Elo(Ta)_c752, pd6Elo(Ta)_c4696, pd9Elo(Ta)_c4589) keto-acyl-CoA-reductase (pKR (Ta)_c1703) and the *Sphaeroforma arctica* d4-desaturase d4Des(Sa) and lysophospholipid-coenzyme A synthase (LACS). The polynucleotides of the present invention are particularly suitable for the recombinant manufacture of LCPUFAs and, in particular, arachidonic acid (ARA), eicosapentaenoic acid (EPA) and/or docosapentaenoic acid (DHA).

In a preferred embodiment of the polynucleotide of the present invention, said polynucleotide further comprises an expression control sequence operatively linked to the said nucleic acid sequence.

The term "expression control sequence" as used herein refers to a nucleic acid sequence which is capable of governing, i.e. initiating and controlling, transcription of a nucleic acid sequence of interest, in the present case the nucleic sequences recited above. Such a sequence usually comprises or consists of a promoter or a combination of a promoter and enhancer sequences. Expression of a polynucleotide comprises transcription of the nucleic acid molecule, preferably, into a translatable mRNA. Additional regulatory elements may include transcriptional as well as translational enhancers. The following promoters and expression control sequences may be, preferably, used in an expression vector according to the present invention. The cos, tac, trp, tet, trp-tet, lpp, lac, lpp-lac, lacIq, T7, T5, T3, gal, trc, ara, SP6, λ-PR or λ-PL promoters are, preferably, used in Gram-negative bacteria. For Gram-positive bacteria, promoters amy and SPO2 may be used. From yeast or fungal promoters ADC1, AOX1r, GAL1, MFα, AC, P-60, CYC1, GAPDH, TEF, rp28, ADH are, preferably, used. For animal cell or organism expression, the promoters CMV-, SV40-, RSV-promoter (Rous sarcoma virus), CMV-enhancer, SV40-enhancer are preferably used. From plants the promoters CaMV/35S (Franck 1980, Cell 21: 285-294], PRP1 (Ward 1993, Plant. Mol. Biol. 22), SSU, OCS, lib4, usp, STLS1, B33, nos or the ubiquitin or phaseolin promoter. Also preferred in this context are inducible promoters, such as the promoters described in EP 0 388 186 A1 (i.e. a benzylsulfonamide-inducible promoter), Gatz 1992, Plant J. 2:397-404 (i.e. a tetracyclin-inducible promoter), EP 0 335 528 A1 (i.e. a abscisic-acid-inducible promoter) or WO 93/21334 (i.e. a ethanol- or cyclohexenol-inducible promoter). Further suitable plant promoters are the promoter of cytosolic FBPase or the ST-LSI promoter from potato (Stockhaus 1989, EMBO J. 8, 2445), the phosphoribosyl-pyrophosphate amidotransferase promoter from *Glycine max* (Genbank accession No. U87999) or the node-specific promoter described in EP 0 249 676 A1. Particularly preferred are promoters which enable the expression in tissues which are involved in the biosynthesis of fatty acids. Also particularly preferred are seed-specific promoters such as the USP promoter in accordance with the practice, but also other promoters such as the LeB4, DC3, phaseolin or napin promoters. Further especially preferred promoters are seed-specific promoters which can be used for monocotyledonous or dicotyledonous plants and which are described in U.S. Pat. No. 5,608,152 (napin promoter from oilseed rape), WO 98/45461 (oleosin promoter from Arobidopsis, U.S. Pat. No. 5,504,200 (phaseolin promoter from *Phaseolus vulgaris*), WO 91/13980 (Bce4 promoter from *Brassica*), by Baeumlein et al., Plant J., 2, 2, 1992:233-239 (LeB4 promoter from a legume), these promoters being suitable for dicots. The following promoters are suitable for monocots: Ipt-2 or Ipt-1 promoter from barley (WO 95/15389 and WO 95/23230), hordein promoter from barley and other promoters which are suitable and which are described in WO 99/16890. In principle, it is possible to use all natural promoters together with their regulatory sequences, such as those mentioned above, for the novel process. Likewise, it is possible and advantageous to use synthetic promoters, either additionally or alone, especially when they mediate a seed-specific expression, such as, for example, as described in WO 99/16890. In a particular embodiment, seed-specific promoters are utilized to enhance the production of the desired PUFA or LCPUFA.

The term "operatively linked" as used herein means that the expression control sequence and the nucleic acid of interest are linked so that the expression of the said nucleic acid of interest can be governed by the said expression control sequence, i.e. the expression control sequence shall be functionally linked to the said nucleic acid sequence to be expressed. Accordingly, the expression control sequence and, the nucleic acid sequence to be expressed may be physically linked to each other, e.g., by inserting the expression control sequence at the 5"end of the nucleic acid sequence to be expressed. Alternatively, the expression control sequence and the nucleic acid to be expressed may be merely in physical proximity so that the expression control sequence is capable of governing the expression of at least one nucleic acid sequence of interest. The expression control sequence and the nucleic acid to be expressed are, preferably, separated by not more than 500 bp, 300 bp, 100 bp, 80 bp, 60 bp, 40 bp, 20 bp, 10 bp or 5 bp.

In a further preferred embodiment of the polynucleotide of the present invention, said polynucleotide further comprises a terminator sequence operatively linked to the nucleic acid sequence.

The term "terminator" as used herein refers to a nucleic acid sequence which is capable of terminating transcription. These sequences will cause dissociation of the transcription machinery from the nucleic acid sequence to be transcribed. Preferably, the terminator shall be active in plants and, in particular, in plant seeds. Suitable terminators are known in the art and, preferably, include polyadenylation signals such as the SV40-poly-A site or the tk-poly-A site or one of the plant specific signals indicated in Loke et al. (Loke 2005, Plant Physiol 138, pp. 1457-1468), downstream of the nucleic acid sequence to be expressed.

The present invention also relates to a vector comprising the polynucleotide of the present invention.

The term "vector" or "construct", preferably, encompasses phage, plasmid, viral vectors as well as artificial chromosomes, such as bacterial or yeast artificial chromosomes. Moreover, the term also relates to targeting constructs which allow for random or site-directed integration of the targeting construct into genomic DNA. Such target constructs, preferably, comprise DNA of sufficient length for either homolgous or heterologous recombination as described in detail below. The vector encompassing the polynucleotide of the present invention, preferably, further comprises selectable markers for propagation and/or selection in a host. The vector may be incorporated into a host cell by various techniques well known in the art. If introduced into a host cell, the vector may reside in the cytoplasm or may be incorporated into the genome. In the latter case, it is to be understood that the vector may further comprise nucleic acid sequences which allow for homologous recombination or heterologous insertion. Vectors can be introduced into prokaryotic or eukaryotic cells via conventional transformation or transfection techniques. The terms "transformation" and "transfection", conjugation and transduction, as used in the present context, are intended to comprise a multiplicity of prior-art processes for introducing foreign nucleic acid (for example DNA) into a host cell, including calcium phosphate, rubidium chloride or calcium chloride co-precipitation, DEAE-dextran-mediated transfection, lipofection, natural competence, carbon-based clusters, chemically mediated transfer, electroporation or particle bombardment. Suitable methods for the transformation or transfection of host cells, including plant cells, can be found in Sambrook et al. (Molecular Cloning: A Laboratory Manual, $2^{nd}$ ed., Cold Spring Harbor Laboratory, Cold Spring Harbor Laboratory Press, Cold Spring Harbor, N.Y., 1989) and other laboratory manuals, such as Methods in Molecular Biology, 1995, Vol. 44, *Agrobacterium* protocols, Ed.: Gartland and Davey, Humana Press, Totowa, N.J. Alternatively, a plasmid vector may be introduced by heat shock or electroporation techniques. Should the vector be a virus, it may be packaged in vitro using an appropriate packaging cell line prior to application to host cells.

Preferably, the vector referred to herein is suitable as a cloning vector, i.e. replicable in microbial systems. Such vectors ensure efficient cloning in bacteria and, preferably, yeasts or fungi and make possible the stable transformation of plants. Those which must be mentioned are, in particular, various binary and co-integrated vector systems which are suitable for the T-DNA-mediated transformation. Such vector systems are, as a rule, characterized in that they contain at least the vir genes, which are required for the *Agrobacterium*-mediated transformation, and the sequences which delimit the T-DNA (T-DNA border). These vector systems, preferably, also comprise further cis-regulatory regions such as promoters and terminators and/or selection markers with which suitable transformed host cells or organisms can be identified. While co-integrated vector systems have vir genes and T-DNA sequences arranged on the same vector, binary systems are based on at least two vectors, one of which bears vir genes, but no T-DNA, while a second one bears T-DNA, but no vir gene. As a consequence, the last-mentioned vectors are relatively small, easy to manipulate and can be replicated both in *E. coli* and in *Agrobacterium*. These binary vectors include vectors from the pBIB-HYG, pPZP, pBecks, pGreen series. Preferably used in accordance with the invention are Bin19, pBI101, pBinAR, pGPTV and pCAMBIA. An overview of binary vectors and their use can be found in Hellens et al, Trends in Plant Science (2000) 5, 446-451. Furthermore, by using appropriate cloning vectors, the polynucleotides can be introduced into host cells or organisms such as plants or animals and, thus, be used in the transformation of plants, such as those which are published, and cited, in: Plant Molecular Biology and Biotechnology (CRC Press, Boca Raton, Fla.), chapter 6/7, pp. 71-119 (1993); F. F. White, Vectors for Gene Transfer in Higher Plants; in: Transgenic Plants, vol. 1, Engineering and Utilization, Ed.: Kung and R. Wu, Academic Press, 1993, 15-38; B. Jenes et al., Techniques for Gene Transfer, in: Transgenic Plants, vol. 1, Engineering and Utilization, Ed.: Kung and R. Wu, Academic Press (1993), 128-143; Potrykus 1991, Annu. Rev. Plant Physiol. Plant Molec. Biol. 42, 205-225.

More preferably, the vector of the present invention is an expression vector. In such an expression vector, i.e. a vector which comprises the polynucleotide of the invention having the nucleic acid sequence operatively linked to an expression control sequence (also called "expression cassette") allowing expression in prokaryotic or eukaryotic cells or isolated fractions thereof. Suitable expression vectors are known in the art such as Okayama-Berg cDNA expression vector pcDV1 (Pharmacia), pCDM8, pRc/CMV, pcDNA1, pcDNA3 (Invitrogene) or pSPORTI (GIBCO BRL). Further examples of typical fusion expression vectors are pGEX (Pharmacia Biotech Inc; Smith 1988, Gene 67:31-40), pMAL (New England Biolabs, Beverly, Mass.) and pRIT5 (Pharmacia, Piscataway, N.J.), where glutathione S-transferase (GST), maltose E-binding protein and protein A, respectively, are fused with the recombinant target protein. Examples of suitable inducible nonfusion *E. coli* expression vectors are, inter alia, pTrc (Amann 1988, Gene 69:301-315) and pET 11d (Studier 1990, Methods in Enzymology 185, 60-89). The target gene expression of the pTrc vector is based on the transcription from a hybrid trp-lac fusion promoter by host RNA polymerase. The target gene expression from the pET 11d vector is based on the transcription of a T7-gn10-lac fusion promoter, which is mediated by a coexpressed viral RNA polymerase (T7 gn1). This viral polymerase is provided by the host strains BL21 (DE3) or HMS174 (DE3) from a resident λ-prophage which harbors a T7 gn1 gene under the transcriptional control of the lacUV 5 promoter. The skilled worker is familiar with other vectors which are suitable in prokaryotic organisms; these vectors are, for example, in *E. coli*, pLG338, pACYC184, the pBR series such as pBR322, the pUC series such as pUC18 or pUC19, the M113mp series, pKC30, pRep4, pHS1, pHS2, pPLc236, pMBL24, pLG200, pUR290, pIN-111113-B1, λgt11 or pBdCl, in *Streptomyces* pIJ101, pIJ364, pIJ702 or pIJ361, in *Bacillus* pUB110, pC194 or pBD214, in *Corynebacterium* pSA77 or pAJ667. Examples of vectors for expression in the yeast *S. cerevisiae* comprise pYep Sec1 (Baldari 1987, Embo J. 6:229-234), pMFa (Kurjan 1982, Cell 30:933-943), pJRY88 (Schultz 1987, Gene 54:113-123) and pYES2 (Invitrogen Corporation, San Diego, Calif.). Vectors and processes for the construction of vectors which are suitable for use in other fungi, such as the filamentous fungi, comprise those which are described in detail in: van den Hondel, C.A.M.J.J., & Punt, P. J. (1991) "Gene transfer systems and vector development for filamentous fungi, in: Applied Molecular Genetics of fungi, J. F. Peberdy et al., Ed., pp. 1-28, Cambridge University Press: Cambridge, or in: More Gene Manipulations in Fungi (J. W. Bennett & L. L. Lasure, Ed., pp. 396-428: Academic Press: San Diego). Further suitable yeast vectors are, for example, pAG-1, YEp6, YEp13 or pEMBLYe23. As an alternative, the polynucleotides of the present invention can be also expressed in insect cells using baculovirus expression vectors. Baculovirus vectors which are available for the expression of proteins in cultured insect cells (for example Sf9 cells) comprise the pAc series (Smith 1983, Mol. Cell Biol. 3:2156-2165) and the pVL series (Lucklow 1989, Virology 170:31-39).

The polynucleotide of the present invention can be expressed in single-cell plant cells (such as algae), see Falciatore 1999, Marine Biotechnology 1 (3):239-251 and the references cited therein, and plant cells from higher plants (for example Spermatophytes, such as arable crops) by using plant expression vectors. Examples of plant expression vectors comprise those which are described in detail in: Becker 1992, Plant Mol. Biol. 20:1195-1197; Bevan 1984, Nucl. Acids Res. 12:8711-8721; Vectors for Gene Transfer in Higher Plants; in: Transgenic Plants, Vol. 1, Engineering and Utilization, Ed.: Kung and R. Wu, Academic Press, 1993, p. 15-38. A plant expression cassette, preferably, comprises regulatory sequences which are capable of controlling the gene expression in plant cells and which are functionally linked so that each sequence can fulfill its function, such as transcriptional termination, for example polyadenylation signals. Preferred polyadenylation signals are those which are derived from *Agrobacterium tumefaciens* T-DNA, such as the gene 3 of the Ti plasmid pTiACH5, which is known as octopine synthase (Gielen 1984, EMBO J. 3, 835) or functional equivalents of these, but all other terminators which are functionally active in plants are also suitable. Since plant gene expression is very often not limited to transcriptional levels, a plant expression cassette preferably comprises other functionally linked sequences such as translation enhancers, for example the overdrive sequence, which comprises the 5'-untranslated tobacco mosaic virus leader sequence, which increases the protein/RNA ratio (Gallie 1987, Nucl. Acids Research 15:8693-8711). As described above, plant gene expression must be functionally linked to a suitable promoter which performs the expression of the gene in a timely, cell-specific or tissue-specific manner. Promoters which can be used are constitutive promoters (Benfey 1989, EMBO J. 8:2195-2202) such as those which are derived from plant viruses such as 35S CAMV (Franck 1980, Cell 21:285-294), 19S CaMV (see U.S. Pat. No. 5,352,605 and WO 84/02913) or plant promoters such as the promoter of the Rubisco small subunit, which is described in U.S. Pat. No. 4,962,028. Other preferred sequences for the use in functional linkage in plant gene expression cassettes are targeting sequences which are required for targeting the gene product into its relevant cell compartment (for a review, see Kermode 1996, Crit. Rev. Plant Sci. 15, 4: 285-423 and references cited therein), for example into the vacuole, the nucleus, all types of plastids, such as amyloplasts, chloroplasts, chromoplasts, the extracellular space, the mitochondria, the endoplasmic reticulum, oil bodies, peroxisomes and other compartments of plant cells. As described above, plant gene expression can also be facilitated via a chemically inducible promoter (for a review, see Gatz 1997, Annu. Rev. Plant Physiol. Plant Mol. Biol., 48:89-108). Chemically inducible promoters are particularly suitable if it is desired that genes are expressed in a time-specific manner. Examples of such promoters are a salicylic-acid-inducible promoter (WO 95/19443), a tetracyclin-inducible promoter (Gatz 1992, Plant J. 2, 397-404) and an ethanol-inducible promoter. Promoters which respond to biotic or abiotic stress conditions are also suitable promoters, for example the pathogen-induced PRP1-gene promoter (Ward 1993, Plant Mol. Biol. 22:361-366), the heat-inducible hsp80 promoter from tomato (U.S. Pat. No.

5,187,267), the cold-inducible alpha-amylase promoter from potato (WO 96/12814) or the wound-inducible pinII promoter (EP 0 375 091 A). The promoters which are especially preferred are those which bring about the expression of genes in tissues and organs in which fatty acid, lipid and oil biosynthesis takes place, in seed cells such as the cells of endosperm and of the developing embryo. Suitable promoters are the napin gene promoter from oilseed rape (U.S. Pat. No. 5,608,152), the USP promoter from *Vicia faba* (Baeumlein 1991, Mol. Gen. Genet. 225 (3):459-67), the oleosin promoter from *Arabidopsis* (WO 98/45461), the phaseolin promoter from *Phaseolus vulgaris* (U.S. Pat. No. 5,504,200), the Bce4 promoter from *Brassica* (WO 91/13980) or the legumin B4 promoter (LeB4; Baeumlein 1992, Plant Journal, 2 (2):233-9), and promoters which bring about the seed-specific expression in monocotyledonous plants such as maize, barley, wheat, rye, rice and the like. Suitable promoters to be taken into consideration are the Ipt2 or Ipt1 gene promoter from barley (WO 95/15389 and WO 95/23230) or those which are described in WO 99/16890 (promoters from the barley hordein gene, the rice glutelin gene, the rice oryzin gene, the rice prolamin gene, the wheat gliadin gene, wheat glutelin gene, the maize zein gene, the oat glutelin gene, the *sorghum* kasirin gene, the rye secalin gene). Likewise, especially suitable are promoters which bring about the plastid-specific expression since plastids are the compartment in which the precursors and some end products of lipid biosynthesis are synthesized. Suitable promoters such as the viral RNA-polymerase promoter, are described in WO 95/16783 and WO 97/06250, and the clpP promoter from *Arabidopsis*, described in WO 99/46394. The abovementioned vectors are only a small overview of vectors to be used in accordance with the present invention. Further vectors are known to the skilled worker and are described, for example, in: Cloning Vectors (Ed., Pouwels, P. H., et al., Elsevier, Amsterdam-New York-Oxford, 1985, ISBN 0 444 904018). For further suitable expression systems for prokaryotic and eukaryotic cells see the chapters 16 and 17 of Sambrook, loc cit.

It follows from the above that, preferably, said vector is an expression vector. More preferably, the said polynucleotide of the present invention is under the control of a seed-specific promoter in the vector of the present invention. A preferred seed-specific promoter as meant herein is selected from the group consisting of Conlinin 1, Conlinin 2, napin, LuFad3, USP, LeB4, Arc, Fae, ACP, LuPXR, and SBP. For details, see, e.g., US 2003-0159174.

Moreover, the present invention relates to a host cell comprising the polynucleotide or the vector of the present invention.

Preferably, said host cell is a plant cell and, more preferably, a plant cell obtained from an oilseed crop. More preferably, said oilseed crop is selected from the group consisting of flax (*Linum* sp.), rapeseed (*Brassica* sp.), soybean (*Glycine* and *Soja* sp.), sunflower (*Helianthus* sp.), cotton (*Gossypium* sp.), corn (*Zea mays*), olive (*Olea* sp.), safflower (*Carthamus* sp.), cocoa (*Theobroma cacoa*), peanut (*Arachis* sp.), hemp, camelina, *crambe*, oil palm, coconuts, groundnuts, sesame seed, castor bean, *lesquerella*, tallow tree, sheanuts, tungnuts, kapok fruit, poppy seed, jojoba seeds and *perilla*.

Also preferably, said host cell is a microorganism. More preferably, said microorganism is a bacterium, a fungus or algae. More preferably, it is selected from the group consisting of *Candida, Cryptococcus, Lipomyces, Rhodosporidium, Yarrowia*, and *Schizochytrium*.

Moreover, a host cell according to the present invention may also be an animal cell. Preferably, said animal host cell is a host cell of a fish or a cell line obtained therefrom. More preferably, the fish host cell is from herring, salmon, sardine, redfish, eel, carp, trout, halibut, mackerel, zander or tuna.

Generally, the controlling steps in the production of LCPUFAs, i.e., the long chain unsaturated fatty acid biosynthetic pathway, are catalyzed by membrane-associated fatty acid elongase complexes. Plants and most other eukaryotic organisms have specialized elongase system for the extension of fatty acids beyond C18 atoms. These elongase reactions have several important features in common with the fatty acid synthase complex (FAS). However, the elongase complex is different from the FAS complex as the complex is localized in the cytosol and membrane bound, ACP is not involved and the elongase 3-keto-acyl-CoA-synthase catalyzes the condensation of malonyl-CoA with an acyl primer. The elongase complex consists of four components with different catalytic functions, the keto-acyl-CoA-synthase (KCS, condensation reaction of malonyl-CoA to acyl-CoA, creation of a 2 C atom longer keto-acyl-CoA fatty acid), the keto-acyl-CoA-reductase (KCR, reduction of the 3-keto group to a 3-hydroxy-group), the dehydratase (DH, dehydration results in a delta-2-enoyl-acyl-CoA fatty acid) and the enoly-CoA-reductase (ECR, reduction of the double bond at position 2, release from the complex). For the production of LCPUFAs including ARA, EPA and/or DHA the elongation and desaturation reactions could be essential. Higher plants do not have the necessary enzyme set to produce LCPUFAs (4 or more double bonds, 20 or more C atoms). Therefore the catalytic activities have to be conferred to the plants or plant cells. Critical steps in the process of LCPUFA biosynthesis are the elongation of fatty acids from 18 to 24 carbon atoms and desaturation of carbon atoms. Polynucleotides of the present invention surprisingly catalyze the keto-acyl-CoA-synthase, keto-acyl-CoA-reductase reactions and therefore catalyze the elongation of 18 carbon atoms fatty acids. Polynucleotides of the present invention surprisingly catalyze the desaturation of the $4^{th}$, $9^{th}$, $12^{th}$, $15^{th}$ and $17^{th}$ fatty acids carbon atom bonds. By delivering these enzymes increased levels of PUFAs and LCPUFAs are produced.

However, it will be understood that dependent on the host cell, further, enzymatic activities may be conferred to the host cells, e.g., by recombinant technologies. Accordingly, the present invention, preferably, envisages a host cell which in addition to the polynucleotide of the present invention comprises polynucleotides encoding such desaturases and/or elongases as required depending on the selected host cell. Preferred desaturases and/or elongases which shall be present in the host cell are at least one enzyme selected from the group consisting of: d4-desaturase, d5-desaturase, d5-elongase, d6-desaturase, d12-desaturase, d15-desaturase, ω3-desaturase d-6-elongase or d-9-elongase. Especially preferred are the bifunctional d12d15-desaturases d12d15Des(Ac) from *Acanthamoeba castellanii* (WO2007042510), d12d15Des(Cp) from *Claviceps purpurea* (WO2008006202) and d12d15Des(Lg)1 from *Lottia gigantea* (WO2009016202), the d12-desaturases d12Des (Co) from *Calendula officinalis* (WO200185968), d12Des (Lb) from Laccaria bicolor (WO2009016202), d12Des(Mb) from *Monosiga brevicollis* (WO2009016202), d12Des(Mg) from *Mycosphaerella graminicola* (WO2009016202), d12Des(Nh) from *Nectria haernatococca* (WO2009016202), d12Des(Ol) from *Ostreococcus lucimarinus* (WO2008040787), d12Des(Pb) from *Phycomyces blakesleeanus* (WO2009016202), d12Des(Ps) from *Phy-* tophthora sojae (WO2006100241) and d12Des(Tp) from Thalassiosira pseudonana (WO2006069710), the d15-desaturases d15Des(Hr) from Helobdella robusta (WO2009016202), d15Des(Mc) from Microcoleus chthonoplastes (WO2009016202), d15Des(Mf) from Mycosphaerella fijiensis (WO2009016202), d15Des(Mg) from Mycosphaerella graminicola (WO2009016202) and d15Des(Nh)2 from Nectria haematococca (WO2009016202), the d4-desaturases d4Des(Eg) from Euglena gracilis (WO2004090123), d4Des(Tc) from Thraustochytrium sp. (WO2002026946) and d4Des(Tp) from Thalassiosira pseudonana (WO2006069710), the d5-desaturases d5Des (Ol)2 from Ostreococcus lucimarinus (WO2008040787), d5Des(Pp) from Physcomitrella patens (WO2004057001), d5Des(Pt) from Phaeodactylum tricornutum (WO2002057465), d5Des(Tc) from Thraustochytrium sp. (WO2002026946), d5Des(Tp) from Thalassiosira pseudonana (WO2006069710) and the d6-desaturases d6Des(Cp) from Ceratodon purpureus (WO2000075341), d6Des(Ol) from Ostreococcus lucimarinus (WO2008040787), d6Des (Ot) from Ostreococcus tauri (WO2006069710), d6Des(Pf) from Primula farinosa (WO2003072784), d6Des(Pir)_BO from Pythium irregulare (WO2002026946), d6Des(Pir) from Pythium irregulare (WO2002026946), d6Des(Plu) from Primula luteola (WO2003072784), d6Des(Pp) from Physcomitrella patens (WO200102591), d6Des(Pt) from Phaeodactylum tricornutum (WO2002057465), d6Des(Pv) from Primula vialii (WO2003072784) and d6Des(Tp) from Thalassiosira pseudonana (WO2006069710), the d8-desaturases d8Des(Ac) from Acanthamoeba castellanii (EP1790731), d8Des(Eg) from Euglena gracilis (WO200034439) and d8Des(Pm) from Perkinsus marinus (WO2007093776), the o3-desaturases o3Des(Pi) from Phytophthora infestans (WO2005083053), o3Des(Pir) from Pythium irregulare (WO2008022963), o3Des(Pir)2 from Pythium irregulare (WO2008022963) and o3Des(Ps) from Phytophthora sojae (WO2006100241), the bifunctional d5d6-elongases d5d6Elo(Om)2 from Oncorhynchus mykiss (WO2005012316), d5d6Elo(Ta) from Thraustochytrium aureum (WO2005012316) and d5d6Elo(Tc) from Thraustochytrium sp. (WO2005012316), the d5-elongases d5Elo (At) from Arabidopsis thaliana (WO2005012316), d5Elo (At)2 from Arabidopsis thaliana (WO2005012316), d5Elo (Ci) from Ciona intestinalis (WO2005012316), d5Elo(Ol) from Ostreococcus lucimarinus (WO2008040787), d5Elo (Ot) from Ostreococcus tauri (WO2005012316), d5Elo(Tp) from Thalassiosira pseudonana (WO2005012316) and d5Elo(Xl) from Xenopus laevis (WO2005012316), the d6-elongases d6Elo(Ol) from Ostreococcus lucimarinus (WO2008040787), d6Elo(Ot) from Ostreococcus tauri (WO2005012316), d6Elo(Pi) from Phytophthora infestans (WO2003064638), d6Elo(Pir) from Pythium irregulare (WO2009016208), d6Elo(Pp) from Physcomitrella patens (WO2001059128), d6Elo(Ps) from Phytophthora sojae (WO2006100241), d6Elo(Ps)2 from Phytophthora sojae (WO2006100241), d6Elo(Ps)3 from Phytophthora sojae (WO2006100241), d6Elo(Pt) from Phaeodactylum tricornutum (WO2005012316), d6Elo(Tc) from Thraustochytrium sp. (WO2005012316) and d6Elo(Tp) from Thalassiosira pseudonana (WO2005012316), the d9-elongases d9Elo (Ig) from Isochrysis galbana (WO2002077213), d9Elo(Pm) from Perkinsus marinus (WO2007093776) and d9Elo(Ro) from Rhizopus oryzae (WO2009016208). Particularly, if the manufacture of ARA is envisaged in higher plants, the enzymes recited in table 5 or 6, below (i.e. additionally a d6-desaturase, d6-elongase, d5-desaturase, and d12-desaturase) or enzymes having essentially the same activity may be combined in a host cell. If the manufacture of EPA is envisaged in higher plants, the enzymes recited in table 7, below (i.e. additionally a d6-desaturase, d6-elongase, d5-desaturase, d12-desaturase, omega 3-desaturase and d15-desaturase), or enzymes having essentially the same activity may be combined in a host cell. If the manufacture of DHA is envisaged in higher plants, the enzymes recited in table 8, below (i.e. additionally a d6-desaturase, d6-elongase, d5-desaturase, d12-desaturase, omega 3-desaturase, d15-desaturase, d5-elongase, and d4-desaturase), or enzymes having essentially the same activity may be combined in a host cell.

The present invention also relates to a cell, preferably a host cell as specified above or a cell of a non-human organism specified elsewhere herein, said cell comprising a polynucleotide which is obtained from the polynucleotide of the present invention by a point mutation, a truncation, an inversion, a deletion, an addition, a substitution and homologous recombination. How to carry out such modifications to a polynucleotide is well known to the skilled artisan and has been described elsewhere in this specification in detail.

The present invention also provides a plant or part of a plant comprising the delta-4 desaturase, keto-acyl-CoA synthase (KCS), keto-acyl-CoA reductase (KCR) or lysophospholipid-coenzyme A synthase (LACS) activity and/or corresponding nucleic acids, and also provides a corresponding dead plant or part thereof, preferably harvest material, e.g. seeds or leaves, or refuse material, for example straw, dead leaves and press cake. Press cake is the substance obtained after pressing plant seeds or other plant material for oil extraction. Such press cakes generally still comprise high concentrations of polyunsaturated fatty acids and are suitable particularly as animal feed, e.g. fish feed. The invention also provides a container comprising plant material, preferably seeds, and/or refuse material as described above.

The present invention furthermore pertains to a method for the manufacture of a polypeptide encoded by a polynucleotide of any the present invention comprising
a) cultivating the host cell of the invention under conditions which allow for the production of the said polypeptide; and
b) obtaining the polypeptide from the host cell of step a).

Suitable conditions which allow for expression of the polynucleotide of the invention comprised by the host cell depend on the host cell as well as the expression control sequence used for governing expression of the said polynucleotide. These conditions and how to select them are very well known to those skilled in the art. The expressed polypeptide may be obtained, for example, by all conventional purification techniques including affinity chromatography, size exclusion chromatography, high pressure liquid chromatography (HPLC) and precipitation techniques including antibody precipitation. It is to be understood that the method may—although preferred—not necessarily yield an essentially pure preparation of the polypeptide. It is to be understood that depending on the host cell which is used for the aforementioned method, the polypeptides produced thereby may become posttranslationally modified or processed otherwise.

The present invention encompasses a polypeptide encoded by the polynucleotide of the present invention or which is obtainable by the aforementioned method.

The term "polypeptide" as used herein encompasses essentially purified polypeptides or polypeptide preparations comprising other proteins in addition. Further, the term also relates to the fusion proteins or polypeptide fragments being at least partially encoded by the polynucleotide of the present invention referred to above. Moreover, it includes chemically modified polypeptides. Such modifications may be artificial modifications or naturally occurring modifications such as phosphorylation, glycosylation, myristylation and the like (Review in Mann 2003, Nat. Biotechnol. 21, 255-261, review with focus on plants in Huber 2004, Curr. Opin. Plant Biol. 7, 318-322). Currently, more than 300 posttranslational modifications are known (see full ABFRC Delta mass list at www.abrforg/index.cfm/dm.home). The polypeptide of the present invention shall exhibit the desaturase, keto-acyl-CoA-synthase and keto-acyl-CoA-reductase activity referred to above.

Encompassed by the present invention is, furthermore, an antibody which specifically recognizes the polypeptide of the invention.

Antibodies against the polypeptides of the invention can be prepared by well known methods using a purified polypeptide according to the invention or a suitable fragment derived therefrom as an antigen. A fragment which is suitable as an antigen may be identified by antigenicity determining algorithms well known in the art. Such fragments may be obtained either from the polypeptide of the invention by proteolytic digestion or may be a synthetic peptide. Preferably, the antibody of the present invention is a monoclonal antibody, a polyclonal antibody, a single chain antibody, a chimerized antibody or a fragment of any of these antibodies, such as Fab, Fv or scFv fragments etc. Also comprised as antibodies by the present invention are bispecific antibodies, synthetic antibodies or chemically modified derivatives of any of the aforementioned antibodies. The antibody of the present invention shall specifically bind (i.e. does significantly not cross react with other polypeptides or peptides) to the polypeptide of the invention. Specific binding can be tested by various well known techniques. Antibodies or fragments thereof can be obtained by using methods which are described, e.g., in Harlow and Lane "Antibodies, A Laboratory Manual", CSH Press, Cold Spring Harbor, 1988. Monoclonal antibodies can be prepared by the techniques originally described in Köhler 1975, Nature 256, 495, and Galfré 1981, Meth. Enzymol. 73, 3, which comprise the fusion of mouse myeloma cells to spleen cells derived from immunized mammals. The antibodies can be used, for example, for the immunoprecipitation, immunolocalization or purification (e.g., by affinity chromatography) of the polypeptides of the invention as well as for the monitoring of the presence of said variant polypeptides, for example, in recombinant organisms, and for the identification of proteins or compounds interacting with the proteins according to the invention.

Moreover, the antibody according to the present invention can be applied for identifying the presence or absence of the polypeptides of the present invention. Preferably, the antibody is used for identifying non-human transgenic organisms as specified elsewhere herein and, preferably, transgenic plants, which comprise the polypeptides of the present invention. To this end, the antibody may be provided in form of a kit which allows for identifying non-human transgenic organisms and, preferably, transgenic plants comprising the polypeptides of the present invention. The kit, in addition to the antibody of the present invention, may further comprise a detection agent for detecting a complex of the antibody of the invention and the polypeptide of the invention.

Moreover, the present invention contemplates a non-human transgenic organism comprising the polynucleotide or the vector of the present invention.

Preferably, the non-human transgenic organism is a plant, plant part, or plant seed. Preferred plants to be used for introducing the polynucleotide or the vector of the invention are plants which are capable of synthesizing fatty acids, such as all dicotyledonous or monocotyledonous plants, algae or mosses. It is to be understood that host cells derived from a plant may also be used for producing a plant according to the present invention. Preferred plants are selected from the group of the plant families Adelotheciaceae, Anacardiaceae, Asteraceae, Apiaceae, Betulaceae, Boraginaceae, Brassicaceae, Bromeliaceae, Caricaceae, Cannabaceae, Convolvulaceae, Chenopodiaceae, Crypthecodiniaceae, Cucurbitaceae, Ditrichaceae, Elaeagnaceae, Ericaceae, Euphorbiaceae, Fabaceae, Geraniaceae, Gramineae, Juglandaceae, Lauraceae, Leguminosae, Linaceae, Prasinophyceae or vegetable plants or ornamentals such as *Tagetes*. Examples which may be mentioned are the following plants selected from the group consisting of: Adelotheciaceae such as the genera *Physcomitrella*, such as the genus and species *Physcomitrella patens*, Anacardiaceae such as the genera *Pistacia, Mangifera, Anacardium*, for example the genus and species *Pistacia vera* [pistachio], *Mangifer indica* [mango] or *Anacardium occidentale* [cashew], Asteraceae, such as the genera *Calendula, Carthamus, Centaurea, Cichorium, Cynara, Helianthus, Lactuca, Locusta, Tagetes, Valeriana*, for example the genus and species *Calendula officinalis* [common marigold], *Carthamus tinctorius* [safflower], *Centaurea cyanus* [cornflower], *Cichorium intybus* [chicory], *Cynara scolymus* [artichoke], *Helianthus annus* [sunflower], *Lactuca sativa, Lactuca crispa, Lactuca esculenta, Lactuca scariola* L. ssp. *sativa, Lactuca scariola* L. var. *integrata, Lactuca scariola* L. var. *integrifolia, Lactuca sativa* subsp. *romana, Locusta communis, Valeriana locusta* [salad vegetables], *Tagetes lucida, Tagetes erecta* or *Tagetes tenuifolia* [african or french marigold], Apiaceae, such as the genus *Daucus*, for example the genus and species *Daucus carota* [carrot], Betulaceae, such as the genus *Corylus*, for example the genera and species *Corylus avellana* or *Corylus colurna* [hazelnut], Boraginaceae, such as the genus *Borago*, for example the genus and species *Borago officinalis* [borage], Brassicaceae, such as the genera *Brassica, Melanosinapis, Sinapis, Arabadopsis*, for example the genera and species *Brassica napus, Brassica rapa* ssp. [oilseed rape], *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis* [mustard], *Brassica oleracea* [fodder beet] or *Arabidopsis thaliana*, Bromeliaceae, such as the genera *Anana, Bromelia* (pineapple), for example the genera and species *Anana comosus, Ananas ananas* or *Bromelia comosa* [pineapple], Caricaceae, such as the genus *Carica*, such as the genus and species *Carica papaya* [pawpaw], Cannabaceae, such as the genus *Cannabis*, such as the genus and species *Cannabis sativa* [hemp], Convolvulaceae, such as the genera *Ipomea, Convolvulus*, for example the genera and species *Ipomoea batatus, Ipomoea pandurata, Convolvulus batatas, Convolvulus tiliaceus, Ipomoea fastigiata, Ipomoea tiliacea, Ipomoea triloba* or *Convolvulus panduratus* [sweet potato, batate], Chenopodiaceae, such as the genus *Beta*, such as the genera and species *Beta vulgaris, Beta vulgaris* var. *altissima, Beta vulgaris* var. *Vulgaris, Beta maritima, Beta vulgaris* var. *perennis, Beta vulgaris* var. *conditiva* or *Beta vulgaris* var. *esculenta* [sugarbeet], Crypthecodiniaceae, such as the genus *Crypthecodinium*, for example the genus and species *Cryptecodinium cohnii*, Cucurbitaceae, such as the genus *Cucurbita*, for example the genera and species *Cucurbita maxima, Cucurbita mixta, Cucurbita pepo* or *Cucurbita moschata* [pumpkin/squash], Cymbellaceae such as the genera *Amphora, Cymbella, Okedenia, Phaeodactylum, Reimeria*, for example the genus and species *Phaeodactylum tricornutum*, Ditrichaceae such as the genera *Ditrichaceae, Astomiopsis, Ceratodon, Chrysoblastella, Ditrichum, Distichium, Eccremidium, Lophidion, Philibertiella, Pleuridium, Saelania, Trichodon, Skottsbergia*, for example the genera and species *Ceratodon antarcticus, Ceratodon columbiae, Ceratodon heterophyllus, Ceratodon purpureus, Ceratodon purpureus, Ceratodon purpureus* ssp. *convolutus, Ceratodon, purpureus* spp. *stenocarpus, Ceratodon purpureus* var. *rotundifolius, Ceratodon ratodon, Ceratodon stenocarpus, Chrysoblastella chilensis, Ditrichum ambiguum, Ditrichum brevisetum, Ditrichum crispatissimum, Ditrichum difficile, Ditrichum falcifolium, Ditrichum flexicaule, Ditrichum giganteum, Ditrichum heteromallum, Ditrichum lineare, Ditrichum lineare, Ditrichum montanum, Ditrichum montanum, Ditrichum pallidum, Ditrichum punctulatum, Ditrichum pusillum, Ditrichum pusillum* var. *tortile, Ditrichum rhynchostegium, Ditrichum schimperi, Ditrichum tortile, Distichium capillaceum, Distichium hagenii, Distichium inclinatum, Distichium macounii, Eccremidium floridanum, Eccremidium whiteleggei, Lophidion strictus, Pleuridium acuminatum, Pleuridium alternifolium, Pleuridium holdridgei, Pleuridium mexicanum, Pleuridium ravenelii, Pleuridium subulatum, Saelania glaucescens, Trichodon borealis, Trichodon cylindricus* or *Trichodon cylindricus* var. *oblongus*, Elaeagnaceae such as the genus *Elaeagnus*, for example the genus and species *Olea europaea* [olive], Ericaceae such as the genus *Kalmia*, for example the genera and species *Kalmia latifolia, Kalmia angustifolia, Kalmia microphylla, Kalmia polifolia, Kalmia occidentalis, Cistus chamaerhodendros* or *Kalmia lucida* [mountain laurel], Euphorbiaceae such as the genera *Manihot, Janipha, Jatropha, Ricinus*, for example the genera and species *Manihot utilissima, Janipha manihot, Jatropha manihot, Manihot aipil, Manihot dulcis, Manihot manihot, Manihot melanobasis, Manihot esculenta* [manihot] or *Ricinus communis* [castor-oil plant], Fabaceae such as the genera *Pisum, Albizia, Cathormion, Feuillea, Inga, Pithecolobium, Acacia, Mimosa, Medicajo, Glycine, Dolichos, Phaseolus, Soja*, for example the genera and species *Pisum sativum, Pisum arvense, Pisum humile* [pea], *Albizia berteriana, Albizia julibrissin, Albizia lebbeck, Acacia berteriana, Acacia littoralis, Albizia berteriana, Albizzia berteriana, Cathormion berteriana, Feuillea berteriana, Inga fragrans, Pithecollobium berterianum, Pithecollobium fragrans, Pithecolobium berterianum, Pseudalbizzia berteriana, Acacia julibrissin, Acacia nemu, Albizia nemu, Feuilleea julibrissin, Mimosa julibrissin, Mimosa speciosa, Sericanrda julibrissin, Acacia lebbeck, Acacia macrophylla, Albizia lebbek, Feuilleea lebbeck, Mimosa lebbeck, Mimosa speciosa* [silk tree], *Medicago sativa, Medicago falcata, Medicago varia* [alfalfa], *Glycine max Dolichos soja, Glycine gracilis, Glycine hispida, Phaseolus max, Soja hispida* or *Soja* max [soybean], Funariaceae such as the genera *Aphanorrhegma, Entosthodon, Funaria, Physcomitrella, Physcomitrium*, for example the genera and species *Aphanorrhegma serratum, Entosthodon attenuatus, Entosthodon bolanderi, Entosthodon bonplandii, Entosthodon californicus, Entosthodon drummondii, Entosthodon jamesonii, Entosthodon leibergii, Entosthodon neoscoticus, Entosthodon rubrisetus, Entosthodon spathulifolius, Entosthodon tucsoni, Funaria americana, Funaria bolanderi, Funaria calcarea, Funaria californica, Funaria calvescens, Funaria convoluta, Funaria flavicans, Funaria groutiana, Funaria hygrometrica, Funaria hygrometrica* var. *arctica, Funaria hygrometrica* var. *calvescens, Funaria hygrometrica* var. *convoluta, Funaria hygrometrica* var. *muralis, Funaria hygrometrica* var. *utahensis, Funaria microstoma, Funaria microstoma* var. *obtusifolia, Funaria muhlenbergii, Funaria orcuttii, Funaria plano-convexa, Funaria polaris, Funaria ravenelii, Funaria rubriseta, Funaria serrata, Funaria sonorae, Funaria sublimbatus, Funaria tucsoni, Physcomitrella californica, Physcomitrella patens, Physcomitrella readeri, Physcomitrium australe, Physcomitrium californicum, Physcomitrium collenchymatum, Physcomitrium coloradense, Physcomitrium cupuliferum, Physcomitrium drummondii, Physcomitrium eurystomum, Physcomitrium flexifolium, Physcomitrium hookeri, Physcomitrium hookeri* var. *serratum, Physcomitrium immersum, Physcomitrium kellermanii, Physcomitrium megalocarpum, Physcomitrium pyriforme, Physcomitrium pyriforme* var. *serratum, Physcomitrium rufipes, Physcomitrium sandbergii, Physcomitrium subsphaericum, Physcomitrium washingtoniense*, Geraniaceae, such as the genera *Pelargonium, Cocos, Oleum*, for example the genera and species *Cocos nucifera, Pelargonium grossularioides* or *Oleum cocois* [coconut], Gramineae, such as the genus *Saccharum*, for example the genus and species *Saccharum officinarum*, Juglandaceae, such as the genera *Juglans, Wallia*, for example the genera and species *Juglans regia, Juglans ailanthifolia, Juglans sieboldiana, Juglans cinerea, Wallia cinerea, Juglans bixbyi, Juglans californica, Juglans hindsii, Juglans intermedia, Juglans jamaicensis, Juglans major, Juglans microcarpa, Juglans nigra* or *Wallia nigra* [walnut], Lauraceae, such as the genera *Persea, Laurus*, for example the genera and species *Laurus nobilis* [bay], *Persea americana, Persea gratissima* or *Persea persea* [avocado], Leguminosae, such as the genus *Arachis*, for example the genus and species *Arachis hypogaea* [peanut], Linaceae, such as the genera *Linum, Adenolinum*, for example the genera and species *Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense* or *Linum trigynum* [linseed], Lythrarieae, such as the genus *Punica*, for example the genus and species *Punica granatum* [pomegranate], Malvaceae, such as the genus *Gossypium*, for example the genera and species *Gossypium hirsutum, Gossypium arboreum, Gossypium barbadense, Gossypium herbaceum* or *Gossypium thurberi* [cotton], Marchandiaceae, such as the genus *Marchantia*, for example the genera and species *Marchantia berteroana, Marchantia foliacea, Marchantia macropora*, Musaceae, such as the genus *Musa*, for example the genera and species *Musa nana, Musa acuminata, Musa paradisiaca, Musa* spp. [banana], Onagraceae, such as the genera *Camissonia, Oenothera*, for example the genera and species *Oenothera biennis* or *Camissonia brevipes* [evening primrose], Palmae, such as the genus *Elacis*, for example the genus and species *Elaeis guineensis* [oil palm], Papaveraceae, such as the genus *Papaver*, for example the genera and species *Papaver orientale, Papaver rhoeas, Papaver dubium* [poppy], Pedaliaceae, such as the genus *Sesamum*, for example the genus and species *Sesamum indicum* [sesame], Piperaceae, such as the genera *Piper, Artanthe, Peperomia, Steffensia*, for example the genera and species *Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata* [cayenne pepper], Poaceae, such as the genera *Hordeum, Secale, Avena, Sorghum, Andropogon, Holcus, Panicum, Oryza, Zea* (maize), *Triticum*, for example the genera and species *Hordeum vulgare, Hordeum jubatum, Hordeum murinum, Hor-*

*deum secalinum, Hordeum distichon, Hordeum aegiceras, Hordeum hexastichon, Hordeum hexastichum, Hordeum irregulare, Hordeum sativum, Hordeum secalinum* [barley], *Secale cereale* [rye], *Avena sativa, Avena fatua, Avena byzantina, Avena fatua* var. *sativa, Avena hybrida* [oats], *Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum, Panicum militaceum* [millet], *Oryza sativa, Oryza latifolia* [rice], *Zea mays* [maize], *Triticum aestivum, Triticum durum, Triticum turgidum, Triticum hybernum, Triticum macha, Triticum sativum* or *Triticum vulgare* [wheat], Porphyridiaceae, such as the genera *Chroothece, Flintiella, Petrovanella, Porphyridium, Rhodella, Rhodosorus, Vanhoeffenia*, for example the genus and species *Porphyridium cruentum*, Proteaceae, such as the genus *Macadamia*, for example the genus and species *Macadamia intergrifolia* [macadamia], Prasinophyceae such as the genera *Nephroselmis, Prasinococcus, Scherffelia, Tetraselmis, Mantoniella, Ostreococcus*, for example the genera and species *Nephroselmis olivacea, Prasinococcus capsulatus, Scherffelia dubia, Tetraselmis chui, Tetraselmis suecica, Mantoniella squamata, Ostreococcus tauri*, Rubiaceae such as the genus *Cofea*, for example the genera and species *Cofea* spp., *Coffea arabica, Coffea canephora* or *Coffea liberica* [coffee], Scrophulariaceae such as the genus *Verbascum*, for example the genera and species *Verbascum blattaria, Verbascum chaixii, Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum* or *Verbascum thapsus* [mullein], Solanaceae such as the genera *Capsicum, Nicotiana, Solanum, Lycopersicon*, for example the genera and species *Capsicum annuum, Capsicum annuum* var. *glabriusculum, Capsicum frutescens* [pepper], *Capsicum annuum* [paprika], *Nicotiana tabacum, Nicotiana alata, Nicotiana attenuata, Nicotiana glauca, Nicotiana langsdorffii, Nicotiana obtusifolia, Nicotiana quadrivalvis, Nicotiana repanda, Nicotiana rustica, Nicotiana sylvestris* [tobacco], *Solanum tuberosum* [potato], *Solanum melongena* [eggplant], *Lycopersicon esculentum, Lycopersicon lycopersicum, Lycopersicon pyriforme, Solanum integrifolium* or *Solanum lycopersicum* [tomato], Sterculiaceae, such as the genus *Theobroma*, for example the genus and species *Theobroma cacao* [cacao] or Theaceae, such as the genus *Camellia*, for example the genus and species *Camellia sinensis* [tea]. In particular preferred plants to be used as transgenic plants in accordance with the present invention are oil fruit crops which comprise large amounts of lipid compounds, such as peanut, oilseed rape, canola, sunflower, safflower, poppy, mustard, hemp, castor-oil plant, olive, sesame, *Calendula, Punica*, evening primrose, mullein, thistle, wild roses, hazelnut, almond, *macadamia*, avocado, bay, pumpkin/squash, linseed, soybean, pistachios, borage, trees (oil palm, coconut, walnut) or crops such as maize, wheat, rye, oats, triticale, rice, barley, cotton, cassava, pepper, *Tagetes*, Solanaceae plants such as potato, tobacco, eggplant and tomato, *Vicia* species, pea, alfalfa or bushy plants (coffee, cacao, tea), Salix species, and perennial grasses and fodder crops. Preferred plants according to the invention are oil crop plants such as peanut, oilseed rape, canola, sunflower, safflower, poppy, mustard, hemp, castor-oil plant, olive, *Calendula, Punica*, evening primrose, pumpkin/squash, linseed, soybean, borage, trees (oil palm, coconut). Especially preferred are sunflower, safflower, tobacco, mullein, sesame, cotton, pumpkin/squash, poppy, evening primrose, walnut, linseed, hemp, thistle or safflower. Very especially preferred plants are plants such as safflower, sunflower, poppy, evening primrose, walnut, linseed, or hemp.

Preferred mosses are *Physcomitrella* or *Ceratodon*. Preferred algae are *Isochrysis, Mantoniella, Ostreococcus* or *Crypthecodinium*, and algae/diatoms such as *Phaeodactylum* or *Thraustochytrium*. More preferably, said algae or mosses are selected from the group consisting of: *Shewanella, Physcomitrella, Thraustochytrium, Fusarium, Phytophthora, Ceratodon, Isochrysis, Aleurita, Muscarioides, Mortierella, Phaeodactylum, Cryphthecodinium*, specifically from the genera and species *Thalassiosira pseudonona, Euglena gracilis, Physcomitrella patens, Phytophthora infestans, Fusarium graminaeum, Cryptocodinium cohnii, Ceratodon purpureus, Isochrysis galbana, Aleurita farinosa, Thraustochytrium* sp., *Muscarioides viallii, Mortierella alpina, Phaeodactylum tricornutum* or *Caenorhabditis elegans* or especially advantageously *Phytophthora infestans, Thalassiosira pseudonona* and *Cryptocodinium cohnii*.

Transgenic plants may be obtained by transformation techniques as elsewhere in this specification. Preferably, transgenic plants can be obtained by T-DNA-mediated transformation. Such vector systems are, as a rule, characterized in that they contain at least the vir genes, which are required for the *Agrobacterium*-mediated transformation, and the sequences which delimit the T-DNA (T-DNA border). Suitable vectors are described elsewhere in the specification in detail.

Also encompassed are transgenic non-human animals comprising the vector or polynucleotide of the present invention. Preferred non-human transgenic animals envisaged by the present invention are fish, such as herring, salmon, sardine, redfish, eel, carp, trout, halibut, mackerel, zander or tuna.

However, it will be understood that dependent on the non-human transgenic organism specified above, further, enzymatic activities may be conferred to the said organism, e.g., by recombinant technologies. Accordingly, the present invention, preferably, envisages a non-human transgenic organism specified above which in addition to the polynucleotide of the present invention comprises polynucleotides encoding such desaturases and/or elongases as required depending on the selected host cell. Preferred desaturases and/or elongases which shall be present in the organism are at least one enzyme selected from the group of desaturases and/or elongases or the combinations specifically recited elsewhere in this specification (see above and tables 5, 6 and 7).

Furthermore, the present invention encompasses a method for the manufacture of polyunsaturated fatty acids comprising:
a) cultivating the host cell of the invention under conditions which allow for the production of polyunsaturated fatty acids in said host cell; and
b) obtaining said polyunsaturated fatty acids from the said host cell.

The term "polyunsaturated fatty acids (PUFA)" as used herein refers to fatty acids comprising at least two, preferably, three, four, five or six, double bonds. Moreover, it is to be understood that such fatty acids comprise, preferably, from 18 to 24 carbon atoms in the fatty acid chain. More preferably, the term relates to long chain PUFA (LCPUFA) having from 20 to 24 carbon atoms in the fatty acid chain. Preferred unsaturated fatty acids in the sense of the present invention are selected from the group consisting of DGLA 20:3 (8,11,14), ARA 20:4 (5,8,11,14), iARA 20:4 (8,11,14,17), EPA 20:5 (5,8,11,14,17), DPA 22:5 (4,7,10,13,16), DHA 22:6 (4,7,10,13,16,19), 20:4 (8,11,14,17), more preferably, arachidonic acid (ARA) 20:4 (5,8,11,14), eicosapentaenoic acid (EPA) 20:5 (5,8,11,14,17), and docosahexaenoic acid (DHA) 22:6 (4,7,10,13,16,19). Thus, it will be understood that most preferably, the methods provided by the present invention pertaining to the manufacture of ARA, EPA or DHA. Moreover, also encompassed are the intermediates of LCPUFA which occur during synthesis. Such intermediates are, preferably, formed from substrates by the desaturase, keto-acyl-CoA-synthase and keto-acyl-CoA-reductase activity of the polypeptide of the present invention. Preferably, substrates encompass LA 18:2 (9,12), GLA 18:3 (6,9,12), DGLA 20:3 (8,11,14), ARA 20:4 (5,8,11,14), eicosadienoic acid 20:2 (11,14), eicosatetraenoic acid 20:4 (8,11,14,17), eicosapentaenoic acid 20:5 (5,8,11,14,17).

The term "cultivating" as used herein refers maintaining and growing the host cells under culture conditions which allow the cells to produce the said polyunsaturated fatty acid, i.e. the PUFA and/or LCPUFA referred to above. This implies that the polynucleotide of the present invention is expressed in the host cell so that the desaturase, keto-acyl-CoA-synthase and keto-acyl-CoA-reductase activity is present. Suitable culture conditions for cultivating the host cell are described in more detail below.

The term "obtaining" as used herein encompasses the provision of the cell culture including the host cells and the culture medium as well as the provision of purified or partially purified preparations thereof comprising the polyunsaturated fatty acids, preferably, ARA, EPA, DHA, in free or in -CoA bound form, as membrane phospholipids or as triacylglyceride estres. More preferably, the PUFA and LCPUFA are to be obtained as triglyceride esters, e.g., in form of an oil. More details on purification techniques can be found elsewhere herein below.

The host cells to be used in the method of the invention are grown or cultured in the manner with which the skilled worker is familiar, depending on the host organism. Usually, host cells are grown in a liquid medium comprising a carbon source, usually in the form of sugars, a nitrogen source, usually in the form of organic nitrogen sources such as yeast extract or salts such as ammonium sulfate, trace elements such as salts of iron, manganese and magnesium and, if appropriate, vitamins, at temperatures of between 0° C. and 100° C., preferably between 10° C. and 60° C. under oxygen or anaerobic atmosphere dependent on the type of organism. The pH of the liquid medium can either be kept constant, that is to say regulated during the culturing period, or not. The cultures can be grown batchwise, semibatchwise or continuously. Nutrients can be provided at the beginning of the fermentation or administered semicontinuously or continuously: The produced PUFA or LCPUFA can be isolated from the host cells as described above by processes known to the skilled worker, e.g., by extraction, distillation, crystallization, if appropriate precipitation with salt, and/or chromatography. It might be required to disrupt the host cells prior to purification. To this end, the host cells can be disrupted beforehand. The culture medium to be used must suitably meet the requirements of the host cells in question. Descriptions of culture media for various microorganisms which can be used as host cells according to the present invention can be found in the textbook "Manual of Methods for General Bacteriology" of the American Society for Bacteriology (Washington D.C., USA, 1981). Culture media can also be obtained from various commercial suppliers. All media components are sterilized, either by heat or by filter sterilization. All media components may be present at the start of the cultivation or added continuously or batchwise, as desired. If the polynucleotide or vector of the invention which has been introduced in the host cell further comprises an expressible selection marker, such as an antibiotic resistance gene, it might be necessary to add a selection agent to the culture, such as a antibiotic in order to maintain the stability of the introduced polynucleotide. The culture is continued until formation of the desired product is at a maximum. This is normally achieved within 10 to 160 hours. The fermentation broths can be used directly or can be processed further. The biomass may, according to requirement, be removed completely or partially from the fermentation broth by separation methods such as, for example, centrifugation, filtration, decanting or a combination of these methods or be left completely in said broth. The fatty acid preparations obtained by the method of the invention, e.g., oils, comprising the desired PUFA or LCPUFA as triglyceride esters are also suitable as starting material for the chemical synthesis of further products of interest. For example, they can be used in combination with one another or alone for the preparation of pharmaceutical or cosmetic compositions, foodstuffs, or animal feeds. Chemically pure triglycerides comprising the desired PUFA or LCPUFA can also be manufactured by the methods described above. To this end, the fatty acid preparations are further purified by extraction, distillation, crystallization, chromatography or combinations of these methods. In order to release the fatty acid moieties from the triglycerides, hydrolysis may be also required. The said chemically pure triglycerides or free fatty acids are, in particular, suitable for applications in the food industry or for cosmetic and pharmacological compositions.

Moreover, the present invention relates to a method for the manufacture of poly-unsaturated fatty acids comprising:
a) cultivating the non-human transgenic organism of the invention under conditions which allow for the production of poly-unsaturated fatty acids in said host cell; and
b) obtaining said poly-unsaturated fatty acids from the said non-human transgenic organism.

Further, it follows from the above that a method for the manufacture of an oil, lipid or fatty acid composition is also envisaged by the present invention comprising the steps of any one of the aforementioned methods and the further step of formulating PUFA or LCPUFA as oil, lipid or fatty acid composition. Preferably, said oil, lipid or fatty acid composition is to be used for feed, foodstuffs, cosmetics or medicaments. Accordingly, the formulation of the PUFA or LCPUFA shall be carried out according to the GMP standards for the individual envisaged products. For example, an oil may be obtained from plant seeds by an oil mill. However, for product safety reasons, sterilization may be required under the applicable GMP standard. Similar standards will apply for lipid or fatty acid compositions to be applied in cosmetic or pharmaceutical compositions. All these measures for formulating oil, lipid or fatty acid compositions as products are comprised by the aforementioned manufacture.

For the production of ARA it is, preferably, envisaged to cultivate a host cell of the invention or a non-human transgenic organism which comprises a combination of polynucleotides of the present invention. Preferably, a combination of the polynucleotides of the invention is envisaged which encode a d12 desaturase, a d6 desaturase, a d6 elongase, a d5 desaturase and KCR (see also Table 5 in the accompanying Examples).

For the production of ARA it is, alternatively but also preferably, envisaged to cultivate a host cell of the invention or a non-human transgenic organism which comprises a combination of polynucleotides of the present invention. Preferably, a combination of the polynucleotides of the invention is envisaged which encode a d12 desaturase, a d9 elongase, a d8 desaturase, a d5 desaturase and KCR (see also Table 6 in the accompanying Examples).

For the production of EPA it is, preferably, envisaged to cultivate a host cell of the invention or a non-human transgenic organism which comprises a combination of polynucleotides of the present invention. Preferably, a combination of the polynucleotides which are preferably applied for the ARA production specified above is used together with a polynucleotide of the present invention encoding a d15 desaturase and a polynucleotide of the present invention encoding a omega-3 desaturase (i.e. a combination of the activities referred to either in Table 7 with those of Table 5 or Table 6).

For the production of DHA it is, preferably, envisaged to cultivate a host cell of the invention or a non-human transgenic organism which comprises a combination of polynucleotides of the present invention. Preferably, a combination of the polynucleotides which are preferably applied for the EPA production specified above is used together with a polynucleotide of the present invention encoding a d5 elongase and a polynucleotide of the present invention encoding a d4 desaturase (i.e. a combination of the activities referred to either in Table 5 and Table 7 with those of Table 8 or Table 6 and Table 7 with those of Table 8)

The present invention also relates to an oil comprising a polyunsaturated fatty acid obtainable by the aforementioned methods.

The term "oil" refers to a fatty acid mixture comprising unsaturated and/or saturated fatty acids which are esterified to triglycerides. Preferably, the triglycerides in the oil of the invention comprise PUFA or LCPUFA as referred to above. The amount of esterified PUFA and/or LCPUFA is, preferably, approximately 30%, a content of 50% is more preferred, a content of 60%, 70%, 80% or more is even more preferred. The oil may further comprise free fatty acids, preferably, the PUFA and LCPUFA referred to above. For the analysis, the fatty acid content can be, e.g., determined by GC analysis after converting the fatty acids into the methyl esters by transesterification. The content of the various fatty acids in the oil or fat can vary, in particular depending on the source. The oil, however, shall have a non-naturally occurring composition with respect to the PUFA and/or LCPUFA composition and content. It is known that most of the fatty acids in plant oil are esterified in triacylglycerides. Accordingly, in the oil of the invention, the PUFAs and LCPUFAs are, preferably, also occur in esterified form in the triacylglcerides. It will be understood that such a unique oil composition and the unique esterification pattern of PUFA and LCPUFA in the triglycerides of the oil shall only be obtainable by applying the methods of the present invention specified above. Moreover, the oil of the invention may comprise other molecular species as well. Specifically, it may comprise minor impurities of the polynucleotide or vector of the invention. Such impurities, however, can be detected only by highly sensitive techniques such as PCR.

All references cited in this specification are herewith incorporated by reference with respect to their entire disclosure content and the disclosure content specifically mentioned in this specification.

FIGURES

FIG. 1 shows the production of d5 elongated fatty acids in yeast transformed with pYes-pd5Elo(Ta)_c1. The fatty acid spectrum of transgenic yeast fed with different fatty acid are depicted. A: control pYes fed with 20:5n-3, B: pYes-pd5Elo(Ta)_c1 fed with 20:5n-3. The formation of 22:5n-3 demonstrates d5-Elongase activity of pd5Elo(Ta)_c1. The observed rate of convertion of 20:5n-3 to 22:5n-3 is listed in table 5.

FIG. 2 shows an alignment of various delta-4 desaturase polypeptide sequences. "d4Des(Sa)" is the sequence SEQ ID NO. 79 according to the present invention; "d4des(Tc)" indicates the delta-4 desaturase of *Thraustochytrium* as described herein. The sequences in FIG. 2 have the following SEQ ID NOS:
Q6VPV2_PAVLU SEQ ID NO: 235
D6NST0_9EUKA SEQ ID NO: 236
A0PJ29_9EUKA SEQ ID NO: 237
d4Des(Sa) SEQ ID NO: 79/238
d4Des(Tc) SEQ ID NO: 239
Q8S3C0_9STRA-*Thraustochytrium*_sp_ATCC21685 SEQ ID NO: 240
Q45G27_9STRA-*Thraustochytrium*_sp_FJN-SEQ ID NO: 241
Q8GZS4_9STRA-*Thraustochytrium_aureum* SEQ ID NO: 242
Q8GZS5_9STRA-*Thraustochytrium_aureum* SEQ ID NO: 243
Q8GZS6_9STRA-*Thraustochytrium_aureum* SEQ ID NO: 244
Q8GZS3_9STRA-*Thraustochytrium_aureum* SEQ ID NO: 245
B8LEI2_THAPS-*Thalassiosira_pseudonana* SEQ ID NO: 246
Q4G2T0_THAPS-*Thalassiosira_pseudonana* SEQ ID NO: 247
Q6WNG7_EUGGR-*Euglena*_gracilis SEQ ID NO: 248
F2U823_SALS5-*Salpingoeca* SEQ ID NO: 249
Q4QFK0_LEIMA-*Leishmania*_major SEQ ID NO: 250

FIG. 3 shows a list of various delta-4 desaturase polypeptide sequences according to the invention, in decreasing order of sequence identity to SEQ ID NO. 79. The sequences are obtained by mutating the sequence of SEQ ID NO. 79 while maintaining preferred conserved sequence motifs as described above.

The invention will now be illustrated by the following Examples which, however, shall not be construed as limiting the scope of the claims or of the invention.

EXAMPLES

Example 1: General Cloning Methods

Cloning methods as e.g. use of restriction endonucleases to cut double stranded DNA at specific sites, agarose gel electrophoreses, purification of DNA fragments, transfer of nucleic acids onto nitrocellulose and nylon membranes, ligation of DNA fragments, transformation of *E. coli* cells and culture of bacteria were performed as described in Sambrook et al. (1989) (Cold Spring Harbor Laboratory Press: ISBN 0-87965-309-6).

Example 2: Sequence Analysis of Recombinant DNA

Sequencing of recombinant DNA molecules was performed using a laser-fluorescence DNA sequencer (Applied Biosystems Inc, USA) employing the sanger method (Sanger et al. (1977) Proc. Natl. Acad. Sci. USA 74, 5463-5467). Expression constructs harboring fragments obtained by polymerase chain reaction were subjected to sequencing to confirm the correctness of the expression cassettes consisting of promoter, nucleic acid molecule to be expressed and terminator to avoid mutations that might result from handling of the DNA during cloning, e.g. due to incorrect primers, mutations from exposure to UV-light or errors of polymerases.

Example 3: Cloning of Yeast Expression Construct Via Homologous Recombination The open reading frame listed in SEQ ID NOs: 1, 4, 7, 10, 13, 16, 19, 22, 25, 28, 31, 78 and 83 encoding polypeptides with the amino acid sequence SEQ ID NOs: 2, 5, 8, 11, 14, 17, 20, 23, 26, 29, 32, 79, 84, 85 or 86 that have desaturase, elongase, KCR or LACS activity, respectively can be amplified using the primers listed in table 2 in a polymerase chain reaction. By doing so, the open reading frame is 5' fused to about 60 nucleotides of the 3' end of the GAL1 promoter sequence with simultaneous introduction of an Asc I and/or Nco I restriction site between the fusion site and 3' fused to about 60 nucleotides of the 5' end of the CYC1 terminator sequence with simultaneous introduction of an Pac I restriction site. To integrate these fragments into pYES2.1 TOPO downstream of the galactose inducible GAL1 Promoter via homologous recombination, the vector pYES2.1 (Invitrogen) can be digested using the restriction endonucleases Pvu II and Xba I, and *Saccharomyces cerevisiae* can be transformed with 5 to 20 ng of linearized pYES2.1 TOPO vector and 20 to 100 ng PCR product per 50 µl competent cells using the transformation method described by Schiestl et al. (Schiestl et al. (1989) Curr. Genet. 16(5-6), pp. 339-346), to obtain pYes-pd6Des(Ta)_c3318, pYes-pd9Des(Ta)_c4008, pYes-po3Des(Ta)_c959, pYes-po3Des(Ta)_c1830, pYes-pd12Des(Ta)_c1219, pYes-pd5Elo(Ta)_c1, pYes-pd6Elo(Ta)_c231, pYes-pd6Elo(Ta)_c752, pYes-pd6Elo(Ta)_c4696, pYes-pd9Elo(Ta)_c4589, pYes-pKCR(Ta)_c1703 and pYes-d4Des(Sa) in various wildtype yeasts. Positive transformants can be selected based on the complementation of the URA auxotrophy of the chosen *S. cerevisiae* strain. To validate the correctness of the expression construct harbored by a particular yeast clone, plasmids can be isolated as described in Current Protocols in Molecular Biology (Hoffmann, Curr. Protoc. Mol. Biol. 2001 May; Chapter 13:Unit13.11), transformed into *E. coli* for amplification and subjected to sequencing of the expression cassette as described in Example 2.

TABLE 2

Primer sequences for cloning polynucleotides of desaturase, keto-acyl-CoA-synthase, keto-acyl-CoA-reductase, dehydratase and enoyl-CoA-reductase of the invention for expression in yeast
A list of identified full-length coding sequences is shown in Table 2.

| Gene-Name | Primer | SEQ-ID |
|---|---|---|
| pd6Des(Ta)_c3318 | Forward:<br>ataaaagtatcaacaaaaaattgttaatatacctctatactttaacgtcaa<br>ggagaaaaaaccccggatcggcgcgccaccatgttcaaccaggcaagcgag<br>ct | 34 |
| | Reverse:<br>aactataaaaaaataaatagggacctagacttcaggttgtctaactcttcc<br>ttttcggttagagcggatttaattaactagccctgcgcgttaatggctt | 35 |
| pd9Des(Ta)_c4008 | Forward:<br>ataaaagtatcaacaaaaaattgttaatatacctctatactttaacgtcaa<br>ggagaaaaaaccccggatcggcgcgccaccatggcggccaacatgtggggc<br>ca | 36 |
| | Reverse:<br>aactataaaaaaataaatagggacctagacttcaggttgtctaactccttc<br>cttttcggttagagcggatttaattaatcacgccaccgtgcgctcgcgca | 37 |
| po3Des(Ta)_c959 | Forward:<br>ataaaagtatcaacaaaaaattgttaatatacctctatactttaacgtcaa<br>ggagaaaaaaccccggatcggcgcgccaccatggcgccagcggttggcaag<br>gc | 38 |
| | Reverse:<br>aactataaaaaaataaatagggacctagacttcaggttgtctaactccttc<br>cttttcggttagagcggatttaattaattgggccttttggactcgcgct | 39 |
| po3Des(Ta)_c1830 | Forward:<br>ataaaagtatcaacaaaaaattgttaatatacctctatactttaacgtcaa<br>ggagaaaaaaccccggatcggcgcgccaccatggcgccccaaaggtcttc<br>tc | 40 |
| | Reverse:<br>aactataaaaaaataaatagggacctagacttcaggttgtctaactccttc<br>cttttcggttagagcggatttaattaatcagagcttggcgtcgcgcgggt | 41 |
| pd12Des(Ta)_c1219 | Forward:<br>ataaaagtatcaacaaaaaattgttaatatacctctatactttaacgtcaa<br>ggagaaaaaaccccggatcggcgcgccaccatgtgcaaggtcgatgggaca<br>aa | 42 |
| | Reverse: | 43 |

TABLE 2-continued

Primer sequences for cloning polynucleotides of desaturase,
keto-acyl-CoA-synthase, keto-acyl-CoA-reductase, dehydratase
and enoyl-CoA-reductase of the invention for expression in yeast
A list of identified full-length coding sequences is shown in Table 2.

| Gene-Name | Primer | SEQ-ID |
|---|---|---|
| | aactataaaaaaataaatagggacctagacttcaggttgtctaactccttc<br>cttttcggttagagcggatttaattaatcagagcttttggccgcacgct | |
| pd5Elo(Ta)_c1 | Forward:<br>ataaaagtatcaacaaaaaattgttaatatacctctatactttaacgtcaa<br>ggagaaaaaaccccggatcggcgcgccaccatggcgacgcgcacctcgaag<br>ag | 44 |
| | Reverse:<br>aactataaaaaaataaatagggacctagacttcaggttgtctaactccttc<br>cttttcggttagagcggatttaattaatcactcggacttggtggggcgc | 45 |
| pd6Elo(Ta)_c231 | Forward:<br>ataaaagtatcaacaaaaaattgttaatatacctctatactttaacgtcaa<br>ggagaaaaaaccccggatcggcgcgccaccatggccgcggccttcatggac<br>tt | 46 |
| | Reverse:<br>aactataaaaaaataaatagggacctagacttcaggttgtctaactccttc<br>cttttcggttagagcggatttaattaatcactccaccttggccttgggcc | 47 |
| pd6Elo(Ta)_c752 | Forward:<br>ataaaagtatcaacaaaaaattgttaatatacctctatactttaacgtcaa<br>ggagaaaaaaccccggatcggcgcgccaccatggaaaatacaatggagcac<br>aa | 48 |
| | Reverse:<br>aactataaaaaaataaatagggacctagacttcaggttgtctaactccttc<br>cttttcggttagagcggatttaattaatcaggtcgacttgagcttgtcgg | 49 |
| pd6Elo(Ta)_c4696 | Forward:<br>ataaaagtatcaacaaaaaattgttaatatacctctatactttaacgtcaa<br>ggagaaaaaaccccggatcggcgcgccaccatgcgcaccgcgtacgaagca<br>gc | 50 |
| | Reverse:<br>aactataaaaaaataaatagggacctagacttcaggttgtctaactccttc<br>cttttcggttagagcggatttaattaactactgcttcttcttctgttgca | 51 |
| pd9Elo(Ta)_c4589 | Forward:<br>ataaaagtatcaacaaaaaattgttaatatacctctatactttaacgtcaa<br>ggagaaaaaaccccggatcggcgcgccaccatggacgtctatgacgcacag<br>cc | 52 |
| | Reverse:<br>aactataaaaaaataaatagggacctagacttcaggttgtctaactccttc<br>cttttcggttagagcggatttaattaatcactgcgacttgagctggtccg | 53 |
| pKCR(Ta)_c1703 | Forward:<br>ataaaagtatcaacaaaaaattgttaatatacctctatactttaacgtcaa<br>ggagaaaaaaccccggatcggcgcgccaccatgaccgagactgtgctgtgg<br>gt | 54 |
| | Reverse:<br>aactataaaaaaataaatagggacctagacttcaggttgtctaactccttc<br>cttttcggttagagcggatttaattaatcaagcgaccttcttcggcgacg | 55 |
| d4Des(Sa) | Forward:<br>ataaaagtatcaacaaaaaattgttaatatacctctatactttaacgtcaa<br>ggagaaaaaaccccggatcggcgcgccaccatgaccgagactgtgctgtgg<br>gt | 81 |
| | Reverse:<br>aactataaaaaaataaatagggacctagacttcaggttgtctaactccttc<br>cttttcggttagagcggatttaattaatcaagcgaccttcttcggcgacg | 82 |

TABLE 3

Coding polynucleotide sequences, amino acid sequences encoded thereby and expressed sequences (mRNA)
of desaturases, elongases or elongase component from *Thraustochytrium aureum* of the invention.

| Gene name | Activity | ORF in bp | SEQ-ID No. | Amino acids | SEQ-ID No. | mRNA in bp | SEQ-ID No. |
|---|---|---|---|---|---|---|---|
| pd6Des(Ta)_c3318 | d6-desaturase | 1641 | 1 | 547 | 2 | 1910 | 3 |
| pd9Des(Ta)_c4008 | d9-desaturase | 1176 | 4 | 354 | 5 | 1440 | 6 |
| po3Des(Ta)_c959 | o3-desaturase | 1119 | 7 | 373 | 8 | 1184 | 9 |
| po3Des(Ta)_c1830 | o3-desaturase | 1566 | 10 | 522 | 11 | 1845 | 12 |

TABLE 3-continued

Coding polynucleotide sequences, amino acid sequences encoded thereby and expressed sequences (mRNA) of desaturases, elongases or elongase component from *Thraustochytrium aureum* of the invention.

| Gene name | Activity | ORF in bp | SEQ-ID No. | Amino acids | SEQ-ID No. | mRNA in bp | SEQ-ID No. |
|---|---|---|---|---|---|---|---|
| pd12Des(Ta)_c1219 | d12-desaturase | 1185 | 13 | 394 | 14 | 1463 | 15 |
| pd5Elo(Ta)_c1 | d5-elongase | 951 | 16 | 316 | 17 | 1253 | 18 |
| pd6Elo(Ta)_c231 | d6-elongase | 912 | 19 | 303 | 20 | 1189 | 21 |
| pd6Elo(Ta)_c752 | d6-elongase | 1176 | 22 | 392 | 23 | 1313 | 24 |
| pd6Elo(Ta)_c4696 | d6-elongase | 969 | 25 | 322 | 26 | 1207 | 27 |
| pd9Elo(Ta)_c4589 | d9-elongase | 789 | 28 | 263 | 29 | 1031 | 30 |
| pKCR(Ta)_c1703 | keto-acyl-CoA reductase | 1071 | 31 | 356 | 32 | 1304 | 33 |
| d4Des(Sa) | d4-desaturase | 942 | 78 | 445 | 79 | 1453 | 80 |
| SA-LACS1 | LACS | | 83 | | 84 | | |

Example 4: Activity Assay in Yeast

As an example the superior activity of identified polypeptides can be confirmed by heterologous expression in yeast. Table 4 and 5 show activity assays of yeasts transformed with pYes-pd6Des(Ta)_c3318 (comprising the *Thraustochytrium aureum* delta-6-desaturase gene), pYes-pd9Des(Ta)_c4008 (comprising the *Thraustochytrium aureum* delta-9-desaturase gene), pYes-po3Des(Ta)_c959 (comprising the *Thraustochytrium aureum* omega-3-desaturase gene), pYes-po3Des(Ta)_c1830 (comprising the *Thraustochytrium aureum* omega-3-desaturase gene), pYes-pd12Des(Ta)_c1219 (comprising the *Thraustochytrium aureum* delta-12-desaturase gene), pYes-pd5Elo(Ta)_c1 (comprising the *Thraustochytrium aureum* delta-5-elongase gene), pYes-pd6Elo(Ta)_c231 (comprising the *Thraustochytrium aureum* delta-6-elongase gene), pYes-pd6Elo(Ta)_c752 (comprising the *Thraustochytrium aureum* delta-6-elongase gene), pYes-pd6Elo(Ta)_c4696 (comprising the *Thraustochytrium aureum* delta-6-elongase gene), pYes-pd9Elo(Ta)_c4589 (comprising the *Thraustochytrium aureum* delta-9-elongase gene), pYes-pKCR(Ta)_c1703 (comprising the *Thraustochytrium aureum* KCR gene) and pYes-d4Des(Sa) (comprising the *Sphaeroforma arctica* delta-4-desaturase gene) constructs. Yeast cells containing the respective plasmids were incubated 12 h in liquid drop out base medium lacking uracil (DOB-U medium) at 28° C., 200 rpm incubated, followed by an additional 12 h in induction medium (DOB-U+2% (w/v) galactose+2% (w/v) raffinose). To the induction medium 250 µM of the respective fatty acids were added to check for enzyme activity and specificity. In addition, the fed substrate, the expected product fatty acid are indicated in table 4 and table 5.

In the gas chromatograms of yeast extracts, transformed with pYes-pd5Elo(Ta)_c1 and fed with 20:5n-3 or 20:4n-6, the fatty acids 22:5n-3 and 22:4n-6 were detected (Table 5, FIG. 1). This result shows that pYes-pd5Elo(Ta)_c1 has d5-elongase activity and exhibits a surprisingly high conversion rate. In a direct comparison of the gene d4Des(Sa) of SEQ ID NO 78 against d4Des(Tc) of SEQ ID NO 76 in a parallel experiment, d4Des(Sa) expressed by construct pYes-d4Des(Sa) was found to have a surprisingly high convertion rate (conversion efficiency) of 22%, compared to convertion rate of only 10% for the gene d4Des(Tc). According to the invention it is believed that the delta-4 desaturases of *Sphaeroforma erotica* and *Thraustochytrium* sp. exhibit a preference for different fatty acid pools, i.e. for fatty acids bound to ACP, to CoA or in phospholipids.

TABLE 4

Yeast feeding experiment setup

| Gene | Vector | Substrate | Product |
|---|---|---|---|
| pd6Des(Ta)_c3318 | pYes-pd6Des(Ta)_c3318 | 18:2n-6 | 18:3n-6 |
| pd6Des(Ta)_c3318 | pYes-pd6Des(Ta)_c3318 | 18:3n-3 | 18:4n-3 |
| pd9Des(Ta)_c4008 | pYes-pd9Des(Ta)_c4008 | 18:0 | 18:1n-9 |
| po3Des(Ta)_c959 | pYes-po3Des(Ta)_c959 | 18:2n-6 | 18:3n-3 |
| po3Des(Ta)_c959 | pYes-po3Des(Ta)_c959 | 20:4n-6 | 20:5n-3 |
| po3Des(Ta)_c1830 | pYes-po3Des(Ta)_c1830 | 18:2n-6 | 18:3n-3 |
| po3Des(Ta)_c1830 | pYes-po3Des(Ta)_c1830 | 20:4n-6 | 20:5n-3 |
| pd12Des(Ta)_c1219 | pYes-pd12Des(Ta)_c1219 | 18:1n-9 | 18:2n-6 |
| pd5Elo(Ta)_c1 | pYes-pd5Elo(Ta)_c1 | 20:4n-6 | 22:4n-6 |
| pd5Elo(Ta)_c1 | pYes-pd5Elo(Ta)_c1 | 20:5n-3 | 20:5n-3 |
| pd6Elo(Ta)_c231 | pYes-pd6Elo(Ta)_c231 | 18:3n-6 | 20:3n-6 |
| pd6Elo(Ta)_c231 | pYes-pd6Elo(Ta)_c231 | 18:4n-3 | 20:4n-3 |
| pd6Elo(Ta)_c752 | pYes-pd6Elo(Ta)_c752 | 18:3n-6 | 20:3n-6 |
| pd6Elo(Ta)_c752 | pYes-pd6Elo(Ta)_c752 | 18:4n-3 | 20:4n-3 |
| pd6Elo(Ta)_c4696 | pYes-pd6Elo(Ta)_c4696 | 18:3n-6 | 20:3n-6 |
| pd6Elo(Ta)_c4696 | pYes-pd6Elo(Ta)_c4696 | 18:4n-3 | 20:4n-3 |
| pd9Elo(Ta)_c4589 | pYes-pd9Elo(Ta)_c4589 | 18:2n-6 | 20:2n-6 |
| pd9Elo(Ta)_c4589 | pYes-pd9Elo(Ta)_c4589 | 18:3n-3 | 20:3n-3 |
| d4Des(Sa) | pYes-d4Des(Sa) | 22:4n-6 | 22:5n-6 |
| d4Des(Sa) | pYes-d4Des(Sa) | 22:5n-3 | 22:6n-3 |

TABLE 5

Yeast feeding experiment result. The substrate and product fatty acid are given as percentage of the total fatty acid pool.

| Vector | Substrate | | Product | | Conversion (%) | Activity | FIG. |
|---|---|---|---|---|---|---|---|
| pYes | 20:5n-3 | 54.3 | 20:5n-3 | 0.0 | 0.00 | — | 1A |
| pYes | 20:5n-3 | 63.0 | 20:5n-3 | 0.0 | 0.00 | — | |
| pYes-pd5Elo(Ta)_c1 | 20:5n-3 | 6.9 | 20:5n-3 | 49.6 | 87.74 | d5Elo | 1B |
| pYes-pd5Elo(Ta)_c1 | 20:5n-3 | 6.1 | 20:5n-3 | 46.4 | 88.35 | d5Elo | |
| pYes-pd5Elo(Ta)_c1 | 20:4n-6 | 3.3 | 20:4n-6 | 26.3 | 88.89 | d5Elo | |
| pYes-pd5Elo(Ta)_c1 | 20:4n-6 | 3.7 | 20:4n-6 | 29.3 | 88.69 | d5Elo | |
| pYes-d4Des(Sa) | 22:5n-5 | | 22:6n-3 | | 38.40 | d4Des | |
| pYes-d4Des(Sa) | 22:4n-6 | | 22:5n-6 | | 13.80 | d4Des | |

Example 5: Expression of Desaturase, KCS and KCR in Plants

The novel desaturases, KCS and KCR from *Thraustochytrium aureum* and *Sphaeroforma arctica* can be cloned into a plant transformation vector as described in WO2003/093482, WO2005/083093 or WO2007/093776.

Exemplary suitable combinations of genes for the superior production of ARA, EPA and/or DHA are described in tables 6, 7, 8 and 9.

TABLE 6

Gene combinations for the production of arachidonic acid (ARA). At least one enzyme with a d12-desaturase, d6-desaturase, d6-elongase and d5-desaturase activity are required for arachidonic acid biosynthesis. Various biosynthetic steps can be catalyzed by enzymes of *Thraustochytrium aureum* of the present invention.

| Activity | Gene | Source organism | SEQ ID NO: |
|---|---|---|---|
| d12-desaturase | d12Des(Ps) | *Phytophthora soja* | 56 |
| | pd12Des(Ta)_c1219 | *Thraustochytrium aureum* | 13 |
| d6-desaturase | d6Des(Ot) | *Ostreococcus tauri* | 58 |
| | pd6Des(Ta)_c3318 | *Thraustochytrium aureum* | 1 |
| d6-elongase | d6Elo(Tp) | *Thalassiosira pseudonana* | 60 |
| | d6Elo(Pp) | *Physcomitrella patens* | 62 |
| | pd6Elo(Ta)_c231 | *Thraustochytrium aureum* | 19 |
| | pd6Elo(Ta)_c752 | *Thraustochytrium aureum* | 22 |
| | pd6Elo(Ta)_c4696 | *Thraustochytrium aureum* | 25 |
| d5-desaturase | d5Des(Ta) | *Thraustochytrium sp.* | 64 |
| KCR | pKCR(Ta)_c1703 | *Thraustochytrium aureum* | 31 |

Arachidonic acid may be produced by an alterative pathway involving d9-elongase and d8-desaturase activity. Table 7 shows a combination of genes for this pathway.

TABLE 7

Gene combinations of the alternative pathway for the production of arachidonic acid. Several biosynthetic steps can be catalyzed by enzymes of *Thraustochytrium aureum* of the present invention.

| Activity | Gene | Source organism | SEQ ID NO: |
|---|---|---|---|
| d12-desaturase | d12Des(Ps) | *Phytophthora soja* | 56 |
| | pd12Des(Ta)_c1219 | *Thraustochytrium aureum* | 13 |
| d9-elongase | d9Elo(Ig) | *Isochrysis galbana* | 66 |
| | pd9Elo(Ta)_c4589 | *Thraustochytrium aureum* | 28 |
| d8-desaturase | d8Des(Pm) | *Perkinsus marinus* | 68 |
| d5-desaturase | d5Des(Ta) | *Thraustochytrium sp.* | 64 |
| KCR | pKCR(Ta)_c1703 | *Thraustochytrium aureum* | 31 |

For the production of EPA, the genes listed in table 8 are combined with the genes listed in table 6 or 7.

TABLE 8

For the production of EPA, in addition to combinations of genes listed in table 6 or 7, genes listed in this table can be used.

| Activity | Gene | Source organism | SEQ ID NO: |
|---|---|---|---|
| d15-desaturase | d15Des(Hr) | *Helobdella robusta* | 70 |
| omega-3 desaturase | o3Des(Pi) | *Phytophthora infestans* | 72 |
| | po3Des(Ta)_c959 | *Thraustochytrium aureum* | 7 |
| | po3Des(Ta)_c1830 | *Thraustochytrium aureum* | 10 |

In addition to the genes of table 6 or 7 the genes listed in table 8 and 9 can be used for the biosynthesis of DHA. These genes allow to elongate EPA by 2 carbon atom and dehydrogenation at the 4th and 5th carbon atom, resulting in the generation of DHA.

TABLE 9

For the production of DHA, in addition to the genes of table 6 or 7 and 8, the genes listed in this table can be used.

| Activity | Gene | Source organism | SEQ ID NO: |
|---|---|---|---|
| d5-elongase | d5Elo(Ot) | *Ostreococcus tauri* | 74 |
| | pd5Elo(Ta)_c1 | *Thraustochytrium aureum* | 16 |
| d4-desaturase | d4Des(Tc) | *Thraustochytrium sp.* | 76 |
| | d4Des(Sa) | *Sphaeroforma arctica* | 78 |

Transgenic rapeseed lines are generated as described in Deblaere et al. (1984), (Nucl. Acids. Res. 13, 4777-4788) and seeds of transgenic rapeseed plants are analyzed as described in Qiu et al. (2001)(J. Biol. Chem. 276, 31561-31566).

Example 6: Yeast Feeding with LACS

To investigate the role of this gene by including it in cultures that also carried an elongase and a desaturase gene pair, namely D6ELO(SA) (i.e. delta-6-elongase of *Sphaeroforma arctica*), and DSDES(SA) (i.e. delta-5-desaturase of *Sphaeroforma arctica*), both described in WO2011064181 and WO2011064183. When cultures were induced in the presence of GLA, the first elongation to DGLA in cultures carrying SA-LACS1 (*Sphaeroforma arctica* LACS, SEQ ID NO. 83/84) was lower than that in cultures carrying an empty pYES2.1/V5-His-TOPO vector, reflecting the higher, probably saturated level of substrate available due to the more efficient uptake of GLA in the presence of the acyl CoA-synthetase. However, although DGLA accumulated to similar levels in both samples, desaturation to ARA was approximately 1.6 times as high in the presence of the LACS gene. Similarly, further elongations of DGLA to 22:3n-6 and ARA to 22:4n-6 were more efficient in the presence of SA-LACS1, with elongation of the desaturated product ARA about 1.7 fold higher in the presence of SA-LACS1. Results from experiments where cultures were supplemented with SDA showed a similar trend, with approximately 40% more 20:4Δ 8,11,14.17 desaturated to EPA, and 25% more EPA extended to DHA. The overall lower conversion ratios for this experiment compared to experiments using single genes reflected reduced efficiencies due to different vectors and multiple gene expression.

TABLE 10

Effect of *S. arctica* LACS on elongation and desaturation reactions, when co-expressed in yeast expressing.

| Genes | Reaction: | | | |
|---|---|---|---|---|
| | GLA to DGLA | DGLA to ARA | DGLA to 22:3n-6 | ARA to 22:4n-6 |
| Vector control/D6ELO(SA)/D5DES(SA) | 30.3 ± 1.2 | 43.2 ± 5.1 | 41.7 ± 3.3 | 15.7 ± 1.9 |
| SA-LACS1/D6ELO(SA)/D5DES(SA) | 24.4 ± 1.3 | 68.7 ± 4.9 | 48.5 ± 2.3 | 25.5% ± 2.1% |

| Genes | Reaction: | | | |
|---|---|---|---|---|
| | SDA to 20:4n-3 | 20:4n-3 to EPA | 20:4n-3 to 22:4n-3 | EPA to DPA |
| Vector control/D6ELO(SA)/D5DES(SA) | 32.7% ± 2.3% | 51.5% ± 3.8% | 50.9% ± 2.7% | 30.8% ± 3.1% |
| SA-LACS1/D6ELO(SA)/D5DES(SA) | 24.2% ± 1.4% | 71.6% ± 7.3% | 51.9% ± 1.3% | 40.2% ± 1.1% |

REFERENCE LIST

Arondel, V., Lemieux, B., Hwang, I., Gibson, S., Goodman, H. M., and Somerville, C. R. (1992). Map-based cloning of a gene controlling omega-3 fatty acid desaturation in *Arabidopsis*. Science 258, 1353-1355.

Broadwater, J. A., Whittle, E., and Shanklin, J. (2002). Desaturation and hydroxylation. Residues 148 and 324 of *Arabidopsis* FAD2, in addition to substrate chain length, exert a major influence in partitioning of catalytic specificity. J. Biol. Chem. 277, 15613-15620.

Broun, P., Shanklin, J., Whittle, E., and Somerville, C. (1998b). Catalytic plasticity of fatty acid modification enzymes underlying chemical diversity of plant lipids. Science 282, 1315-1317.

Calvo, A. M., Gardner, H. W., and Keller, N. P. (2001). Genetic connection between fatty acid metabolism and sporulation in *Aspergillus nidulans*. J. Biol. Chem. 276, 25766-25774.

Knutzon, D. S., Thurmond, J. M., Huang, Y. S., Chaudhary, S., Bobik, E G., Jr., Chan, G. M., Kirchner, S. J., and Mukerji, P. (1998). Identification of Delta5-dehydratase from *Mortierella alpina* by heterologous expression in Bakers' yeast and canola. J. Biol. Chem. 273, 29360-29366.

Mantle, P. G. and Nisbet, L. J. (1976). Differentiation of *Claviceps purpurea* in axenic culture. J. Gen. Microbiol. 93, 321-334.

Mey, G., Oeser, B., Lebrun, M. H., and Tudzynski, P. (2002). The biotrophic, non-appressorium-forming grass pathogen *Claviceps purpurea* needs a Fus3/Pmk1 homologous mitogen-activated protein kinase for colonization of rye ovarian tissue. Mol. Plant Microbe Interact. 15, 303-312.

Okuley, J., Lightner, J., Feldmann, K., Yadav, N., Lark, E., and Browse, J. (1994). *Arabidopsis* FAD2 gene encodes the enzyme that is essential for polyunsaturated lipid synthesis. Plant Cell 6, 147-158.

Qi, B., Fraser, T., Mugford, S., Dobson, G., Sayanova, O., Butler, J., Napier, J. A., Stobart, A. K., and Lazarus, C. M. (2004). Production of very long chain polyunsaturated omega-3 and omega-6 fatty acids in plants. Nat. Biotechnol. 22, 739-745.

Shanklin, J. and Cahoon, E. B. (1998). DESATURATION AND RELATED MODIFICATIONS OF FATTY ACIDS1. Annu. Rev. Plant Physiol Plant Mol. Biol. 49, 611-641.

Tudzynski, P., Correia, T., and Keller, U. (2001). Biotechnology and genetics of ergot alkaloids. Appl. Microbiol. Biotechnol. 57, 593-605.

SEQUENCE LISTING (250 sequences)

SEQ ID NO: 1 - DNA, 1497 bp, Thraustochytrium aureum
atgttcaaccaggcaagcgagctcgagtacaagcgccgccagcccgcggcgaggccggacggcacggtgtggcgcgagaagaaaggagaagccgtcgctagccccgtggaggccaagtcgatcgcggagaagcgcgcccaaggcaaagccagaaaagtgacctgggaggaagtaggcaagcacaactcccgggaggacctgtggctcgtcgtcgacggcaaggctttcgacgtctcgagcttcgccgacaagcatcccggcggctacagacccctcgtcgccatggccggccgcgactcgaccgaggtgatgaacgagttccacccggcggccgtcttcgacaagtacctgccgccgtactacatcggagacgttgtcgactacaaagtccccgagctgatcgccgactaccgccaagtgcgccaagagcttctcgcgcgtggcctgttccgcacctccacctcgtactacttggccaagttcgtctggctcgccagcatcctcgcgccaacgctctacggggtcctggcctgctccagcaccacggctcacatgatctccgcagccgggctggccctcttctggcagcagctggcctttgtcggccacgacgtcggccactcggcggtctcgcacgaacgcgcgatcgactactactggggtgggctcttcggcaaccttcttggggggatcagcctgtcctggtggaagcacagccacgagacccaccacgtaacctgcaactcgatcgagatggacccggacattcagcacctgcccttcatcgcgattacctccaagattttcaaggggcgcttctggagcacctaccacctcaagtggttcgagaccgacgcctttgcgcgcttctttgtgatgcaccagaaggcgctcttttacccgatcatgagcttggcgcgcttcaacctctacgtgcagagctggatcctcctcctcttccgcgaggaccgcgacaaggtccccaacaagttcatcgaaatggcctcgcttctcggcttttgggtctggctcttcgcgctcgtgagctccttgccgagctggggcgagcggctcgcgttcttgtacctcagccacgccttcgcgggcatcctgcacattcagatcactctgagccacttcatttctgaaaccttccacggccggtcgacggacaactggatcaagcaccagatgctgacaaccacggacattacttgcccaaagtacatggactggttccacggcggccttcagttccagcttgagcatcaccttttcccgcgcctgccgcggcacaacctgcgcatcgcgcgggaccgcatcatcgcgctcgctgcaaagcacaaccttccttacgcggagatgacctttctggaggccaaccggaagctggttggaatccttggtgagacggcagccgacgcgcagaacctcaagaaaggcgacgggggcttctacaccagcccgattttcgaagccattaacgcgcagggctag

SEQ ID NO: 2 - protein, 498 aa, Thraustochytrium aureum
MFNQASELEYKRRQPAARPDGTVWREKKGEAVASPVEAKSIAEKRAQGKARKVTWEEVGKHNSREDLWLVVDGKAFDVSSFADKHPGGYRPLVAMAGRDSTEVMNEFHPAAVFDKYLPPYYIGDVVDYKVPELIADYRQVRQELLARGLFRTSTSYYLAKFVWLASILAPTLYGVLACSSTTAHMISAAGLALFWQQLAFVGHDVGHSAVSHERAIDYYWGGLFGNLLGGISLSWWKHSHETHHVTCNSIEMDPDIQHLPFIAITSKIFKGRFWSTYHLKWFETDAFARFFVMHQKALFYPIMSLARFNLYVQSWILLLFREDRDKVPNKFIEMASLLGFWVWLFALVSSLPSWGERLAFLYLSHAFAGILHIQITLSHFISETFHGRSTDNWIKHQMLTTTDITCPKYMDWFHGGLQFQLEHHLFPRLPRHNLRIARDRIIALAAKHNLPYAEMTFLEANRKLVGILGETAADAQNLKKGDGGFYTSPIFEAINAQG

SEQ ID NO: 3 - RNA, 1910 nt, Thraustochytrium aureum
aaacaccaacguaggcaggcgacgacgcgcgaccgucgcgcagcccucgcaccaacgagcgcagcuuugaaggacgagcugcagcaccgaacgaacagagcgccagccagcgagggcucaggcagcgcccccgccaggugcccgagcgagugacuccacuugcgcaaaccgcgcuuugaaggcgucgugaagaugagcuccaucaugcugaacgcaaccgcggguagcgccagcuuuacgccagccguugcugcgcuguuaggcguggaggccagcaaggcccugucgcaguccgugauggcggcgguguuccugauuaguuugcugggccagaugaccauguucaaccaggcaagcgagcucgaguacaagcgccgccagcccgcggcgaggccggacggcacgguguggcgcgagaagaaaggagaagccgucgcuagccccguggaggccaagucgaucgcggagaagcgcgcccaaggcaaagccagaaaagugaccugggaggaaguaggcaagcacaacucccgggaggaccuguggcucgucgucgacggcaaggcuuucgacgucucgagcuucgccgacaagcaucccggcggcuacagaccccucgucgccauggccggccgcgacucgaccgaggugaugaacgaguuccacccggcggccgucuucgacaaguaccugccgccguacuacaucggagacguugucgacuacaaaguccccgagcugaucgccgacuaccgccaagugcgccaagagcuucucgcgcguggccuguuccgcaccuccaccucguacuacuuggccaaguucgucuggcucgccagcauccucgcgccaacgcucuacgggguccuggccugcuccagcaccacggcucacaugaucuccgcagccgggcuggcccucuucuggcagcagcuggccuuugucggccacgacgucggccacucggcggucucgcacgaacgcgcgaucgacuacuacuggggugggcucuucggcaaccuucuuggggggaucagccuguccugguggaagcacagccacgagacccaccacguaaccugcaacucgaucgagauggacccggacauucagcaccugcccuucaucgcgauuaccuccaagauuuucaaggggcgcuucuggagcaccuaccaccucaagugguucgagaccgacgccuuugcgcgcuucuuugugaugcaccagaaggcgcucuuuuacccgaucaugagcuuggcgcgcuucaaccucuacgugcagagcuggauccuccuccucuuccgcgaggaccgcgacaagguccccaacaaguucaucgaaauggccucgcuucucggcuuuugggucuggcucuucgcgcucgugagcuccuugccgagcuggggcgagcggcucgcguucuuguaccucagccacgccuucgcgggcauccugcacauucagaucacucugagccacuucauuucugaaaccuuccacggccggucgacggacaacuggaucaagcaccagaugcugacaaccacggacauuacuugcccaaaguacauggacugguuccacggcggccuucaguuccagcuugagcaucaccuuuucccgcgccugccgcggcacaaccugcgcaucgcgcgggaccgcaucaucgcgcucgcugcaaagcacaaccuuccuuacgcggagaugaccuuucuggaggccaaccggaagcugguuggaauccuuggugagacggcagccgacgcgcagaaccucaagaaaggcgacgggggcuucuacaccagcccgauuuucgaagccauuaacgcgcagggcuagcagggcuaggacuuuucccaccagcgcaauuucuuucuuuuuuagguacaaaaaaaaaaaaaaaaaaaaauaaa

SEQ ID NO: 4 - DNA, 1179 bp, Thraustochytrium aureum
atggcggccaacatgtggggccagaacgcttcggcgagcgtggtcgaggccaaccccgaagtcgtggcgagtcgcatgattggcctcgcgacggctctggccgtcggcggcggcatggcgtactacggaacacgcgtgcccaaggacgacaaggtcctcaaaatcgccgacatgcccgagggctacaaggcgcgctccaaggaagagcaggcggccatcgacaagtacgagcgcgaccaaacgctttcccttgtcccgtggctcctgcgcaacacaagctgggtgatggcgacctacatcctcggcgtaaacgtcctcgccgccttcgccgtgccgcacctgttcgactgcaagtggcagacgctcgccggtatgttggcattctacatgattggcgggtttggcgtcacaggcggcctgcacaggctgtggagccacaagtcgtacaagggcaacgtggtgtaccgtttcttggtcatgatctgctcctccattgcaaaccagggcacaatctaccactggagccgcgaccaccgaacgcaccacaagtactccgagacgaaggcagacccgcacaacgcgctgcgcgagtttttcttcgcccacgtaggctggctgctcctgaaaaaggacccgcgcgtcaagtttgctggaaaccaaattcctatggatgacctggccgccatgcccgaggtgcagctgcaaaagcgctttgacccgctctggaacctggcctggtctttcgttgccccggccatcgttggcaacttgctctggggcgagaccgtgtacaagggctttctgctcatgggcgttcttcgctatgtgctctgcctgaacgggacgtggctcgtcaacagcgctgcgcacctgtacggaggccatccgtatgacgagcacattaacccagcggagaactcgatggtgtccatcctctcgatgggcgagggctggcacaactggcaccacgcgttcccgcacgactatgccgcttcggagctcggtgtcagctcgcagtacaaccctaccaagctcttgatcgacatctgcgcgatcttcggcttggtctcggatcgccgccgcgcgcacgaccactgggaggcccggatgaagaagcggggtatctccaaggtcggcctcgagggcccgcctctcctgcgcgagcgcacggtggcgtga

SEQ ID NO: 5 - protein, 354 aa, Thraustochytrium aureum
MAYYGTRVPKDDKVLKIADMPEGYKARSKEEQAAIDKYERDQTLSLVPWLLRNTSWVMATYILGVNVLAAFAVPHLFDCKWQTLAGMLAFYMIGGFGVTGGLHRLWSHKSYKGNVVYRFLVMICSSIANQGTIYHWSRDHRTHHKYSETKADPHNALREFFFAHVGWLLLKKDPRVKFAGNQIPMDDLAAMPEVQLQKRFDPLWNLAWSFVAPAIVGNLLWGETVYKGFLLMGVLRYVLCLNGTWLVNSAAHLYGGHPYDEHINPAENSMVSILSMGEGWHNWHHAFPHDYAASELGVSSQYNPTKLLIDICAIFGLVSDRRRAHDHWEARMKKRGISKVGLEGPPLLRERTVA

SEQ ID NO: 6 - RNA, 1440 nt, Thraustochytrium aureum
aaccccaaucauucaacuugagacgcgucacgaacaagcccugcaaccgccugacuugauuccucgcugaccagcgcucgcgcacaaggacguagcucgugcuauggcggccaacauguggggccagaacgcuucggcgagcguggucgaggccaaccccgaagucguggcgagucgcaugauuggccucgcgacggcucuggccgucggcggcggcauggcguacuacggaacacgcgugcccaaggacgacaagguccucaaaaucgccgacaugcccgagggcuacaaggcgcgcuccaaggaagagcaggcggccaucgacaaguacgagcgcgaccaaacgcuuucccuugucccguggcuccugcgcaacacaagcugggugauggcgaccuacauccucggcguaaacguccucgccgccuucgccgcugccgcaccuguucgacugcaaguggcagacgcucgccgguauguuggcauucuacaugauuggcggguuuggcgucacaggcggccugcacaggcuguggagccacaagucguacaagggcaacgugguguaccguuucuuggucaugaucugcuccuccauugcaaaccagggcacaaucuaccacuggagccgcgaccaccgaacgcaccacaaguacuccgagacgaaggcagacccgcacaacgcgcugcgcgaguuuuucuucgcccacguaggcuggcugcuccugaaaaaggacccgcgcgucaaguuugcuggaaaccaaauuccuauggaugaccuggccgccaugcccgaggugcagcugcaaaagcgcuuugacccgcucuggaaccuggccuggucuuucguugccccggccaucguuggcaacuugcucuggggcgagaccguguacaagggcuuucugcucaugggcguucuucgcuaugugcucugccugaacgggacguggcucgucaacagcgcugcgcaccuguacggaggccauccguaugacgagcacauuaacccagcggagaacucgaugguguccauccucucgaugggcgagggcuggcacaacuggcaccacgcguucccgcacgacuaugccgcuucggagcucggugucagcucgcaguacaacccuaccaagcucuugaucgacaucugcgcgaucuucggcuuggucucggaucgccgccgcgcgcacgaccacugggaggcccggaugaagaagcgggguaucuccaaggucggccucgagggcccgccucuccugcgcgagcgcacgguggcguaggcgcucgcucgacugcgaaccgcuagggcggucccguccgcuguaacuuguagcugccacaacacccgagcccucgaggcuccacuaguagucauguugauugaugugaucaucuuaaaguuuuuuuaaaaaaaaaaaaaaaaaaaaacaaaaaaaa

SEQ ID NO: 7 - DNA, 1119 bp, Thraustochytrium aureum
atggcgccagcggttggcaaggcggcgagcggcgcgacgctcgcgagcagcgccaaagacgtgcccaaggtggagaggaacgggcacttgttcaacaaggaggcgcccaagccaaggcaggacgccaaggagtatgacatcttcaccggagaccacgggctcaagcgccaggaggacctccaggactttatctggacgctgagcgacgagccgcacgcgatccggcgcaagctgatgatgaaggagatgggcaaggagatccaaaagctgaccgggcccgagtggcgcaccgtgccgatcgtcctggtcatgctggccatccaaatcggcatcgggtactacctccgcgcggaggcgggctcgctcaagttttgggtcttcgcgtacgtcttcgggggcacgctggcgcagatcctgttcctcgccaaccacgagatctcgcacaacctggcgttccgctcgcaacgcgccaacaagctcttcgggatcctgaccaacacgcccatgctggtgccgtactttatcgcgttcaaggactaccacaacgagcaccacaagttccagggcacggacgggattgacaccgacctgcccaccgagctggaggcgcgcctcatgtcgtcggtgcctggcaagctgttctacatgttcaaccagacctggttttacgccctccgcccggtcttcatcaagccgcagcccttcaccgcctggcacgctctcaacctcgccgtgcaggtcgcctttatcggcgccgtggtgaacgcctggggcgtgggccccatctggtactttctggcctctgcgcactttgccggctcctggcacccgctcgcgagccactttatcgccgagcactacacctttgccggcgaggccgagacggccagctactacggcccgctcaactacttgacctggaacgtgggctaccacgaccagcaccacgactttccctacgtgccgtggagccgcctcccggagctgcgcaagatcggcgccaagtactacgaccacgtcccctaccacaagagctgggtgcgggcgctctggcacttcctctggaacccgcacatcaccatgtacaaccgcgtcaagcgcgagtccaaaaaggcccaa

SEQ ID NO: 8 - protein, 373 aa, Thraustochytrium aureum
MAPAVGKAASGATLASSAKDVPKVERNGHLFNKEAPKPRQDAKEYDIFTGDHGLKRQEDLQDFIWTLSDEPHAIRRKLMMKEMGKEIQKLTGPEWRTVPIVLVMLAIQIGIGYYLRAEAGSLKFWVFAYVFGGTLAQILFLANHEISHNLAFRSQRANKLFGILTNTPMLVPYFIAFKDYHNEHHKFQGTDGIDTDLPTELEARLMSSVPGKLFYMFNQTWFYALRPVFIKPQPFTAWHALNLAVQVAFIGAVVNAWGVGPIWYFLASAHFAGSWHPLASHFIAEHYTFAGEAETASYYGPLNYLTWNVGYHDQHHDFPYVPWSRLPELRKIGAKYYDHVPYHKSWVRALWHFLWNPHITMYNRVKRESKKAQ

SEQ ID NO: 9 - RNA, 1184 nt, Thraustochytrium aureum
agggauggcgccagcgguuggcaaggcggcgagcggcgcgacgcucgcgagcagcgccaaagacgugcccaagguggagaggaacgggcacuuguucaacaaggaggcgcccaagccaaggcaggacgccaaggaguaugacaucuucaccggagaccacgggcucaagcgccaggaggaccuccaggacuuuaucuggacgcugagcgacgagccgcacgcgauccggcgcaagcugaugaugaaggagaugggcaaggagauccaaaagcugaccgggcccgaguggcgcaccgugccgaucguccuggucaugcuggccauccaaaucggcaucggguacuaccuccgcgcggaggcgggcucgcucaaguuuugggucuucgcguacgucuucgggggcacgcuggcgcagauccuguuccucgccaaccacgagaucucgcacaaccuggcguuccgcucgcaacgcgccaacaagcucuucgggauccugaccaacacgcccaugcuggugccguacuuuaucgcguucaaggacuaccacaacgagcaccacaaguuccagggcacggacgggauugacaccgaccugcccaccgagcuggaggcgcgccucaugucgucggugccuggcaagcuguucuacauguucaaccagaccugguuuuacgcccuccgcccggucuucaucaagccgcagcccuucaccgccuggcacgcucucaaccucgccgugcaggucgccuuuaucggcgccguggugaacgccuggggcgugggccccaucugguacuuucuggccucugcgcacuuugccggcuccuggcacccgcucgcgagccacuuuaucgccgagcacuacaccuuugccggcgaggccgagacggccagcuacuacggcccgcucaacuacuugaccuggaacgugggcuaccacgaccagcaccacgacuuucccuacgugccguggagccgccucccggagcugcgcaagaucggcgccaaguacuacgaccacguccccuaccacaagagcugggugcgggcgcucuggcacuuccucuggaacccgcacaucaccauguacaaccgcgucaagcgcgaguccaaaaaggcccaauaaagaagaccaacgucacaacagaguuacaaaguaaaaaaaaaaaaaaaaaaaaaaaaaa

SEQ ID NO: 10 - DNA, 1569 bp, Thraustochytrium aureum
atggcgcccccaaaggtcttctcgcgcgcagaggtggccaagcacaacaccgaggaagactgctggatcgtgatcgagggacgcgtctacgatgtgaccagttttgctggcatgcaccctggcggcgaggagatcttgctgtcgatcggcggcaccgacgcaaccgaggacttttacggcctgcacagacagagcgtgctcgacaagtttggccccaagctcatggtaggcgtgaccgaggacgccgacatggaggaggtctccaagcccacgaacgggctgaccaagtgggcggagatctcaaaggtgccgtacgccgagacgtttgcctggcgcggcttcaagacgccattccacgacgagtctcacgtgcgcttccgcaagtacattcgcgagttttatgaccgcgagttgcgccagctcgcgatcgagtgcgaggactccaacgagcccgccacgctcgagatcatgcaaaagattagccaagccggcctcctgcacacccgccttggccctgggccgcacctcaagctgctgccgatgccctgcgggatcaagccggaagagttcacttacacgcacgagaagattttgcaggaggagacggcacgcctccaatgccccggtttcctcgactcgctgttcgcggggttcaacatcagcgccccgccgctcgtcaactacggcacggacaagatgcgcaaagaggtgctccccgagattctggccggccgtaagcgttcctgcctggccatcacggaagcttttgctggctccgacgtggccggcctccgcaccacagccaagctcacccccgacggcaagcactacattgtcaacggtaccaagaagtggattaccaacgccacctttgccgactacttcgtcacggccgtgcgcacaggggggcccggcgcgggcggcatttcgatgatgctcattcccaagggggagggtgtccgcgtcaagctgatcaagacggcctacagcagcgcagcaggcacggggtacgtcatgtttgagaacgtcaaggtccccgccgagaacctcatgggcgcagagaacaagggctttggcctcgtcatgagcaacttcaaccacgagcgctatgtgatcgccgttgctgtcatcgcgggctgccgcctcgctgtcgaggagtgcttcaagtgggccatgcagcgcaaggtgtttggcaagccgctcatgagccaagctgtcattcgcgaaaagctcggccgcatggtggccgccgtcgaggccgccgacgcgtacgccgatctcatcacgcaccagatgaacaacatggactacaaggagcaaaacatgaaactcggcggccccatttcgcttctcaagtaccaggcgacgcgcaccgcgcacctcgtcgcggacgatgcggtgcagatcttcggaggccgcggcgtcacgaacggcgccatgggccgcgtggtgcgcaactttgccaagagctacaagctccccagcgtttacgggggctccgaggagatcatggtggacctcggcgttcgtcaagccctccgcttttacccgcgcgacgccaagctctga

SEQ ID NO: 11 - protein, 522 aa, Thraustochytrium aureum
MAPPKVFSRAEVAKHNTEEDCWIVIEGRVYDVTSFAGMHPGGEEILLSIGGTDATEDFYGLHRQSVLDKFGPKLMVGVTEDADMEEVSKPTNGLTKWAEISKVPYAETFAWRGFKTPFHDESHVRFRKYIREFYDRELRQLAIECEDSNEPATLEIMQKISQAGLLHTRLGPGPHLKLLPMPCGIKPEEFTYTHEKILQEETARLQCPGFLDSLFAGFNISAPPLVNYGTDKMRKEVLPEILAGRKRSCLAITEAFAGSDVAGLRTTAKLTPDGKHYIVNGTKKWITNATFADYFVTAVRTGGPGAGGISMMLIPKGEGVRVKLIKTAYSSAAGTGYVMFENVKVPAENLMGAENKGFGLVMSNFNHERYVIAVAVIAGCRLAVEECFKWAMQRKVFGKPLMSQAVIREKLGRMVAAVEAADAYADLITHQMNNMDYKEQNMKLGGPISLLKYQATRTAHLVADDAVQIFGGRGVTNGAMGRVVRNFAKSYKLPSVYGGSEEIMVDLGVRQALRFYPRDAKL

SEQ ID NO: 12 - RNA, 1845 nt, Thraustochytrium aureum
gcucaucccugaacgaccaacgaagcgcaggccgcgagcuacacgaggcacuuacggcugcagaggcgucgagagccgaggcacacccgcgucgcgcacaggcaagcacugccugaaucgcccgccacauggcgcccccaaaggucuucucgcgcgcagagguggccaagcacaacaccgaggaagacugcuggaucgugaucgagggacgcgucuacgaugugaccaguuuugcuggcaugcacccuggcggcgaggagaucuugcugucgaucggcggcaccgacgcaaccgaggacuuuuacggccugcacagacagagcgugcucgacaaguuuggccccaagcucaugguaggcgugaccgaggacgccgacauggaggaggucuccaagcccacgaacgggcugaccaagugggcggagaucucaaaggugccguacgccgagacguuugccuggcgcggcuucaagacgccauuccacgacgagucucacgugcgcuuccgcaaguacauucgcgaguuuuaugaccgcgaguugcgccagcucgcgaucgagugcgaggacuccaacgagcccgccacgcucgagaucaugcaaaagauuagccaagccggccuccugcacacccgccuuggcccugggccgcaccucaagcugcugccgaugcccugcgggaucaagccggaagaguucacuuacacgcacgagaagauuuugcaggaggagacggcacgccuccaaugccccgguuuccucgacucgcuguucgcgggguucaacaucagcgccccgccgcucgucaacuacggcacggacaagaugcgcaaagaggugcuccccgagauucuggccggccguaagcguuccugccuggccaucacggaagcuuuugcuggcuccgacguggccggccuccgcaccacagccaagcucacccccgacggcaagcacuacauugucaacgguaccaagaaguggauuaccaacgccaccuuugccgacuacuucgucacggccgugcgcacaggggggcccggcgcgggcggcauuucgaugaugcucauucccaagggggaggguguccgcgucaagcugaucaagacggccuacagcagcgcagcaggcacgggguacgucauguuugagaacgucaagguccccgccgagaaccucaugggcgcagagaacaagggcuuuggccucgucaugagcaacuucaaccacgagcgcuaugugaucgccguugcugucaucgcgggcugccgccucgcugucgaggagugcuucaagugggccaugcagcgcaagguguuuggcaagccgcucaugagccaagcugucauucgcgaaaagcucggccgcaugguggccgccgucgaggccgccgacgcguacgccgaucucaucacgcaccagaugaacaacauggacuacaaggagcaaaacaugaaacucggcggccccauuucgcuucucaaguaccaggcgacgcgcaccgcgcaccucgucgcggacgaugcggugcagaucuucggaggccgcggcgucacgaacggcgccaugggccgcguggugcgcaacuuugccaagagcuacaagcuccccagcguuuacgggggcuccgaggagaucaugguggaccucggcguucgucaagcccuccgcuuuuacccgcgcgacgccaagcucuagcuaggcugcgccgcucucggccuccuccguccgcucgcacaacaaguagacgccaaccaguuucggccgcgccucaaauaucgucuaaagucauuuauugcuuacccggaaaaaaaaaaaaaaaaaaaaaaaaaaaaaauaaaaaaaa

SEQ ID NO: 13 - DNA, 1185 bp, Thraustochytrium aureum
atgtgcaaggtcgatgggacaaaccgggcgagctcggctcaagcccaggcagagcaggaaaagctgccaaccatcggcgagctgcgcaaggctgtgcccgcgcactgtttcgaaaagtcgacgttgaagagcctgttcttcgtggctcgtgacctggcgttttgcagcgccatcgggtacgcggcctgggagtacatccccgtcgagtggtcaatcaaggccatcgccctgtggaccctgtacgccatagtgcagggcaccgtggcgaccggggtctgggttctgggccacgaaggcggacacggaggaatctcgagctactctattgtcaacgatactgtcgggtacgtgctgcactcgatcctgctcgtgccgtacttttcctggcaggacaagccacaggcgccaccacgcgcggtgcaacaacctcctggacggggagtcgcaaacccggacctcaagcgcaaggtttacaagatgtacgaaaagatcctcgacacggtgggcgaggaagcctttgtgatcatgcagatcgtccttcaccttgtcttagggtggcccatgtacctgctgatgcacgcgaccgggtctcgccgcagccccgtgactgggcaaaagtacaccaaaaagcccaatcacttcaactggggtgcgagcaacgagcagtacccggccaagttgcgcttcaagatttttctgtcctcgcttggcgtgatcgcgacgctcgcagggatcgccgtgctggccaacaagctcggcgccgccaaggtctcgctcatgtactttggcccctacctcgtggtgaatgcctggctcgtgggatacacctggctccagcacaccgaccaggacgccccgcactatggcgaggacgagtggacctggatcaagggcgccatgacgacgatcgaccgcccctacccctggattgtggacgagctccaccaccacatcggcacgacgcacgtttgccaccacctgttttccgacatgccgcactacaaggcccaggaagccaccgaggcgctcaagccggtgctcggcaagcactaccgcttcgacccgaccccgctggcgcaggccatgtggaacaccgctcgcgactgccactacgtcgagggcctcgacggagtgcagtacccgcagtcaatcatcgccgagaagcgtgcggccaaaaagctctga

SEQ ID NO: 14 - protein, 394 aa, Thraustochytrium aureum
MCKVDGTNRASSAQAQAEQEKLPTIGELRKAVPAHCFEKSTLKSLFFVARDLAFCSAIGYAAWEYIPVEWSIKAIALWTLYAIVQGTVATGVWVLGHEGGHGGISSYSIVNDTVGYVLHSILLVPYFSWQDKPQAPPRAVQQPPGRGVANPDLKRKVYKMYEKILDTVGEEAFVIMQIVLHLVLGWPMYLLMHATGSRRSPVTGQKYTKKPNHFNWGASNEQYPAKLRFKIFLSSLGVIATLAGIAVLANKLGAAKVSLMYFGPYLVVNAWLVGYTWLQHTDQDAPHYGEDEWTWIKGAMTTIDRPYPWIVDELHHHIGTTHVCHHLFSDMPHYKAQEATEALKPVLGKHYRFDPTPLAQAMWNTARDCHYVEGLDGVQYPQSIIAEKRAAKKL

SEQ ID NO: 15 - RNA, 1463 nt, Thraustochytrium aureum
aaccccaaucgacaccacgaccgcgcaacgagcgcgccgcaggcagcagacucgaguccgaaagggcucagauugaaaaggagcacaagaugugcaaggucgaugggacaaaccgggcgagcucggcucaagcccaggcagagcaggaaaagcugccaaccaucggcgagcugcgcaaggcugugcccgcgcacuguuucgaaaagucgacguugaagagccuguucuucguggcucgugaccuggcguuuugcagcgccaucggguacgcggccugggaguacauccccgucgaguggucaaucaaggccaucgcccuguggacccuguacgccauagugcagggcaccguggcgaccggggucuggguucugggccacgaaggcggacacggaggaaucucgagcuacucuauugucaacgauacugucggguacgugcugcacucgauccugcucgugccguacuuuuccuggcaggacaagccacaggcgccaccacgcgcggugcaacaaccuccuggacggggagucgcaaacccggaccucaagcgcaagguuuacaagauguacgaaaagauccucgacacggugggcgaggaagccuuugugaucaugcagaucguccuucaccuugucuuaggguggcccauguaccugcugaugcacgcgaccgggucucgccgcagccccgugacugggcaaaaguacaccaaaaagcccaaucacuucaacuggggugcgagcaacgagcaguacccggccaaguugcgcuucaagauuuuucuguccucgcuuggcgugaucgcgacgcucgcagggaucgccgugcuggccaacaagcucggcgccgccaaggucucgcucauguacuuuggccccuaccucguggugaaugccuggcucgugggauacaccuggcuccagcacaccgaccaggacgccccgcacuauggcgaggacgaguggaccuggaucaagggcgccaugacgacgaucgaccgccccuaccccuggauuguggacgagcuccaccaccacaucggcacgacgcacguuugccaccaccuguuuuccgacaugccgcacuacaaggcccaggaagccaccgaggcgcucaagccggugcucggcaagcacuaccgcuucgacccgaccccgcuggcgcaggccauguggaacaccgcucgcgacugccacuacgucgagggccucgacggagugcaguacccgcagucaaucaucgccgagaagcgugcggccaaaaagcucuagagcucuggcucaagggacaccgugccgaaggcugcgauguuugugaguuagcgggguccugcgcugcggugcgccggggcggggcgggcauuuccaccucggccucgucgcauuccaauuugcuggaccucaaccugaacguuuugucaaucaagauacaaaaaaaacccaucaucauuauuugacuaa

SEQ ID NO: 16 - DNA, 951 bp, Thraustochytrium aureum
atggcgacgcgcacctcgaagagcgctccggcggtttccaagtcggccaaggttgccgcgccggcgaagaagcggtcggtcgacaggagcgacggtttcttccgcacgttcaacctgtgcgccctgtacgggtctgccctcgcctatgcgtacaagcacggccaggtggacaatgacggccaggggctgtactttcacaagtcgcccatgtacgcgttcgccgtgtcggacgtcatgaccttcggcgcgccgctgatgtacgtgctcggtgtgatgctgctcagcaggtacatggcggacaaaaagcccctgactggcttcatcaagacctacatccagcccgtctacaacgtggtccaaatcgcggtgtgcggctggatggtgtggggcctctggccgcaggtcgacctggccaacggcaaccctttcggcctcaacaagtcgcgcgactcgaacatcgagtttttcgtgttcgtgcacctcctgacaaagtttctcgactggagcgacacgttcatgatgatcctcaagaaaaactacgcccaggttagctttctgcaggtgttccaccacgcaacgatcggcatggtgtggtcgttccttcttcagcgtggctggggctcgggcaccgccgcgtacggtgctttcatcaactcggtcacgcacgtgatcatgtactcgcactactttgccacctcgctcaacatcaacaacccgttcaagcggtacatcacgagcttccagctcgcccagtttgcaagctgcatcgtgcatgccctactggtgcttgccttcgaggaggtgtacccgctcgagtacgcttacctgcagatcagctaccacatcatcatgctctacctgttcggacgccgcatgaactggagccccgagtggtgcaccggtgagatcgacggccttgacgccccaagcgcccccaccaagtccgagtga

SEQ ID NO: 17 - protein, 316 aa, Thraustochytrium aureum
MATRTSKSAPAVSKSAKVAAPAKKRSVDRSDGFFRTFNLCALYGSALAYAYKHGQVDNDGQGLYFHKSPMYAFAVSDVMTFGAPLMYVLGVMLLSRYMADKKPLTGFIKTYIQPVYNVVQIAVCGWMVWGLWPQVDLANGNPFGLNKSRDSNIEFFVFVHLLTKFLDWSDTFMMILKKNYAQVSFLQVFHHATIGMVWSFLLQRGWGSGTAAYGAFINSVTHVIMYSHYFATSLNINNPFKRYITSFQLAQFASCIVHALLVLAFEEVYPLEYAYLQISYHIIMLYLFGRRMNWSPEWCTGEIDGLDAPSAPTKSE

SEQ ID NO: 18 - RNA, 1253 nt, Thraustochytrium aureum
gcucaaaccccgaacguguuucucccaggacgugccgcugucgcucgcugauccacccgaagcgcggucggcuggcacggucgcucggcuggaaguugaguaguuugcuuucuguugcugcgcugcuuuguaaacgcgaccauggcgacgcgcaccucgaagagcgcuccggcgguuuccaagucggccaagguugccgcgccggcgaagaagcggucggucgacaggagcgacgguuucuuccgcacguucaaccugugcgcccuguacgggucugcccucgccuaugcguacaagcacggccagguggacaaugacggccaggggcuguacuuucacaagucgcccauguacgcguucgccgugucggacgucaugaccuucggcgcgccgcugauguacgugcucggugugaugcugcucagcagguacauggcggacaaaaagccccugacuggcuucaucaagaccuacauccagcccgucuacaacgugguccaaaucgcggugugcggcuggaugguguggggccucuggccgcaggucgaccuggccaacggcaacccuuucggccucaacaagucgcgcgacucgaacaucgaguuuuucguguucgugcaccuccugacaaaguuucucgacuggagcgacacguucaugaugauccucaagaaaaacuacgcccagguuagcuuucugcagguguuccaccacgcaacgaucggcaugguguggucguuccuucuucagcguggcuggggcucgggcaccgccgcguacggugcuuucaucaacucggucacgcacgugaucauguacucgcacuacuuugccaccucgcucaacaucaacaacccguucaagcgguacaucacgagcuuccagcucgcccaguuugcaagcugcaucgugcaugcccuacuggugcuugccuucgaggagguguacccgcucgaguacgcuuaccugcagaucagcuaccacaucaucaugcucuaccuguucggacgccgcaugaacuggagccccgaguggugcaccggugagaucgacggccuugacgccccaagcgcccccaccaaguccgaguaaaccuguuuccggcuggcucccgagccaugcuuaccaugaaugaaccugcaaacagucugagguccuugugcaaaccgcucagugggacgucgacgaagaaagaaacaauguguacucguacuuaagaaaaaaaaaaaaaaaaaaaaaaaaaaaaaaaaaaa

SEQ ID NO: 19 - DNA, 912 bp, Thraustochytrium aureum
atggccgcggccttcatggacttgctgccggtctttgagtgggagcgtatggacctggacgcaatcttggccgtctcagacttcctcgccggaaacatgcacatccccttcatcctctcgggcatctacgtcgtggtcgtgtttgggatccagtacctcctcgaggacagcaagccattcgacctaaagctccccctggctctgtggagcctcggcctggccctcttcagcgtgttcggctcgctccgaaccgtgccgacgctcgccaaactggggtggaaccgcggcctcttgcacgtggtgtgcggcgacacgcggtatgattggctcgtactcgagccggcgggggcctggacagtgctcttcatcttctccaaagcgcccgagctaatcgacacactgttcatcgttctgcgcaagcgcaaactcatcacgctccactggtaccaccacatcacggtgcttctcttctgctggcactcgttggccacgctctgcatgaacggactcatcttctcgtccatgaacctcaccgtacacgccttcatgtactttttctacacgctggccgcgctcgggtaccggcccactgccttcgcggtctacatcacgctgctgcagatcctgcagatgctcgtcgggactgcggttacggtctacgtcaacttgcagcaagttgccgccaaagcggaggacccgtcggcgctcgaggcggcgtccaaggactggctcaacgtcacgtgggacaagtttagctcgcgggagaacccggagaccatctcgacttgcgagaccgtgcaccctgcaagtgcgttcgcgggcctcgccatgtacgcgagctacctgtggctcttcagcgcgttcttctactacgcctacatggcgccgcggcccaaggccaaggtggagtga

SEQ ID NO: 20 - protein, 303 aa, Thraustochytrium aureum
MAAAFMDLLPVFEWERMDLDAILAVSDFLAGNMHIPFILSGIYVVVVFGIQYLLEDSKPFDLKLPLALWSLGLALFSVFGSLRTVPTLAKLGWNRGLLHVVCGDTRYDWLVLEPAGAWTVLFIFSKAPELIDTLFIVLRKRKLITLHWYHHITVLLFCWHSLATLCMNGLIFSSMNLTVHAFMYFFYTLAALGYRPTAFAVYITLLQILQMLVGTAVTVYVNLQQVAAKAEDPSALEAASKDWLNVTWDKFSSRENPETISTCETVHPASAFAGLAMYASYLWLFSAFFYYAYMAPRPKAKVE

SEQ ID NO: 21 - RNA, 1189 nt, Thraustochytrium aureum
aaugggcggccgccuguaaaccgcguucugccucacguacgcggcgcucauggccgcggccuucauggacuugcugccggucuuugagugggagcguauggaccuggacgcaaucuuggccgucucagacuuccucgccggaaacaugcacauccccuucauccucucgggcaucuacgucguggucguguuugggauccaguaccuccucgaggacagcaagccauucgaccuaaagcucccccuggcucuguggagccucggccuggcccucuucagcguguucggcucgcuccgaaccgugccgacgcucgccaaacugggguggaaccgcggccucuugcacguggugugcggcgacacgcgguaugauuggcucguacucgagccggcgggggccuggacagugcucuucaucuucuccaaagcgcccgagcuaaucgacacacuguucaucguucugcgcaagcgcaaacucaucacgcuccacugguaccaccacaucacggugcuucucuucugcuggcacucguuggccacgcucugcaugaacggacucaucuucucguccaugaaccucaccguacacgccuucauguacuuuuucuacacgcuggccgcgcucggguaccggcccacugccuucgcggucuacaucacgcugcugcagauccugcagaugcucgucgggacugcgguuacggucuacgucaacuugcagcaaguugccgccaaagcggaggacccgucggcgcucgaggcggcguccaaggacuggcucaacgucacgugggacaaguuuagcucgcgggagaacccggagaccaucucgacuugcgagaccgugcacccugcaagugcguucgcgggccucgccauguacgcgagcuaccuguggcucuucagcgcguucuucuacuacgccuacauggcgccgcggcccaaggccaagguggaguaagccugcgcugcgcugccuggcagcugggcccaggccccagcgcuaggcucgcagcuuuaguaguaguaguaguuguugucguuguuguugggucgugcgaggcguccuuggccuucgccggccgcgauucgccucaacgcgacgcguugggaaagaaaggagaaaaaaacagauuugccacugcaauaaaaaaaaaaaaaaaaaaaaaaaaaaaaaaaaaaaaaaaaa

SEQ ID NO: 22 - DNA, 1179 bp, Thraustochytrium aureum
atggaaaatacaatggagcacaacagccgcgccatcgataagatgaacgcgggcgttgtgcggcgcgtggtcaagttcggcacgcaggacgtgagccaggcctgcggcgtaatctcgatgggacacaacgagctactcggcgagagcgggccgcggcgccgcggcgaatccgtggagaagcgcaaagagcgcaagcagcgccagaatctcggcgccaaactgttcacggcgtactgcatcgtgttcgcggcgctgatgctgctctccttcatggacctgcttcccgtgtttgagtgggagctgatgaactttgggaccgcggagaaggtctcggtatggctcggcgagcacatgcacctgccgttcgtgtttgcgctcttgtacgtgatcgtaatctttgggatccagtttgcaatggacggcaagaccgagtttgacctgaggtacccacttgcgatctggtcgctcgcgctcgcgctgttcagcctgggcggctccctgcgcaccgtgcccgtcctaatcaagctcctccacaccaagggcgtcatgcacgtcgtgtgcggggacacgcggcaggactgggtcatcgacaacccggccggggtgtggacgatgctcttcatcttttccaaggtgcccgagctgatcgacacgctgttcatcgtgctgcgcaagcgcaaactgatcacgctgcactggtaccaccacatcacggtgatgaccttttgctggcactcgtgggccacttactgcctgaacggcctcgtgtactcgtccatgaacctcactgtgcacgcgttcatgtactttttttacacgctcaccgcgctcgggtaccggcccacgcgattcgcgatctacatcaccgtgatccagatcctgcaaatgctcgtcggcaccgcggtcaccgtctacgtcaactaccacatcaactttgtcgtcacgcagccgctgagcctctcgctgcgcacaaactgggacgcgctcgcgccggagccaaacacggatcccagctgcaaggtccacaccctcaacgccctggcgggcctctgcatgtacgggagctacctgtggctcttttgcgtgttcttttatgtcagctatatccagcccaagccggccaagagcaagtctttggcctctggggaggctgctgccgacaagctcaagtcgacctga

SEQ ID NO: 23 - protein, 392 aa, Thraustochytrium aureum
MENTMEHNSRAIDKMNAGVVRRVVKFGTQDVSQACGVISMGHNELLGESGPRRRGESVEKRKERKQRQNLGAKLFTAYCIVFAALMLLSFMDLLPVFEWELMNFGTAEKVSVWLGEHMHLPFVFALLYVIVIFGIQFAMDGKTEFDLRYPLAIWSLALALFSLGGSLRTVPVLIKLLHTKGVMHVVCGDTRQDWVIDNPAGVWTMLFIFSKVPELIDTLFIVLRKRKLITLHWYHHITVMTFCWHSWATYCLNGLVYSSMNLTVHAFMYFFYTLTALGYRPTRFAIYITVIQILQMLVGTAVTVYVNYHINFVVTQPLSLSLRTNWDALAPEPNTDPSCKVHTLNALAGLCMYGSYLWLFCVFFYVSYIQPKPAKSKSLASGEAAADKLKST

SEQ ID NO: 24 - RNA, 1313 nt, Thraustochytrium aureum
aauggaaaauacaauggagcacaacagccgcgccaucgauaagaugaacgcgggcguugugcggcgcguggucaaguucggcacgcaggacgugagccaggccugcggcguaaucucgaugggacacaacgagcuacucggcgagagcgggccgcggcgccgcggcgaauccguggagaagcgcaaagagcgcaagcagcgccagaaucucggcgccaaacuguucacggcguacugcaucguguucgcggcgcugaugcugcucuccuucauggaccugcuucccguguuugagugggagcugaugaacuuugggaccgcggagaaggucucgguauggcucggcgagcacaugcaccugccguucguguuugcgcucuuguacgugaucguaaucuuugggauccaguuugcaauggacggcaagaccgaguuugaccugagguacccacuugcgaucuggucgcucgcgcucgcgcuguucagccugggcggcucccugcgcaccgugcccguccuaaucaagcuccuccacaccaagggcgucaugcacgucgugugcggggacacgcggcaggacugggucaucgacaacccggccgggguguggacgaugcucuucaucuuuuccaaggugcccgagcugaucgacacgcuguucaucgugcugcgcaagcgcaaacugaucacgcugcacugguaccaccacaucacggugaugaccuuuugcuggcacucgugggccacuuacugccugaacggccucguguacucguccaugaaccucacugugcacgcguucauguacuuuuuuuacacgcucaccgcgcucggguaccggcccacgcgauucgcgaucuacaucaccgugauccagauccugcaaaugcucgucggcaccgcggucaccgucuacgucaacuaccacaucaacuuugucgucacgcagccgcugagccucucgcugcgcacaaacugggacgcgcucgcgccggagccaaacacggaucccagcugcaagguccacacccucaacgcccuggcgggccucugcauguacgggagcuaccuguggcucuuuugcguguucuuuuaugucagcuauauccagcccaagccggccaagagcaagucuuuggccucuggggaggcugcugccgacaagcucaagucgaccugagcgaccgugccuccguuuccaaagccgccguccuucggcgcgggguaaaccguuuucagacgaaacgaaagagaagaaagaagacaaaaaggacuaaccuacgguaguaggguaacguaaaaaaaaaaaaaaa

SEQ ID NO: 25 - DNA, 969 bp, Thraustochytrium aureum
atgcgcaccgcgtacgaagcagcgtggtcgggcaccgtgcacaaggtcaacaacacccaccacgtgttcaagacgaggggcggcggcgagtgcttcttccagagcacgtaccaacttttgcccgagctggagcccaccccgctttacccgttccgcgagacggaaggcgttttcgatgggagccccatgtcggcctacatgcgcgagtactttcagatcccgctcatcctcgtggccctgtacgtcgtggtcatcttctcggggcgcgcggtcatgtcttgcttgccggccgcagacctcacagtgccgctcgcgctgtggaacctggcgctctcccttttcagctgggtcggcgtcttccgcaccgtgccgcaccttttggggacgatcgcgcaccgcggggtctactttagcatgtgcgagccggtttgcgccacgtttggcgcctccgaggtcggcttgtgggcctggctcttcatcatctccaagatccccgagctcatcgacacggttttcatcgtcttgcggaagaagccgctcattttcttgcactggtaccaccacgtcacggtcctcctctactgctgggccagctacacaacgcagaacagcgccgggctctactttatctgcatgaactacaccgtccatgcaattatgtacggctactactttctcaaggcggtcaacatgtggccgcggttcatcccgtcgtggaccatcacgctgctccagctcagccagatggtcggcggcatcgtggtctgctacctcacgtacaagtacgagaaggaggacgggcttccgtgctcgatctccgaggtcgccttcaacaccggcgtcgtcatgtacgggagctattttctcctgttcctgcaaatcctgttctcgcttctctctggcggcaagaaaaagtcggcaggccgtcccaaggcggatgccgggctgcaacagaagaagaagcagtag

SEQ ID NO: 26 - protein, 322 aa, Thraustochytrium aureum
MRTAYEAAWSGTVHKVNNTHHVFKTRGGGECFFQSTYQLLPELEPTPLYPFRETEGVFDGSPMSAYMREYFQIPLILVALYVVVIFSGRAVMSCLPAADLTVPLALWNLALSLFSWVGVFRTVPHLLGTIAHRGVYFSMCEPVCATFGASEVGLWAWLFIISKIPELIDTVFIVLRKKPLIFLHWYHHVTVLLYCWASYTTQNSAGLYFICMNYTVHAIMYGYYFLKAVNMWPRFIPSWTITLLQLSQMVGGIVVCYLTYKYEKEDGLPCSISEVAFNTGVVMYGSYFLLFLQILFSLLSGGKKKSAGRPKADAGLQQKKKQ

SEQ ID NO: 27 - RNA, 1207 nt, Thraustochytrium aureum
gcucagguuuguguuuagcaacccugaugccgcagagccccgggacuggaaggcgacgggggacuggguggcggacaugcgcaccgcguacgaagcagcguggucgggcaccgugcacaaggucaacaacacccaccacguguucaagacgaggggcggcggcgagugcuucuuccagagcacguaccaacuuuugcccgagcuggagcccaccccgcuuuacccguuccgcgagacggaaggcguuuucgaugggagccccaugucggccuacaugcgcgaguacuuucagaucccgcucauccucguggcccuguacgucguggucaucuucucggggcgcgcggucaugucuugcuugccggccgcagaccucacagugccgcucgcgcuguggaaccuggcgcucucccuuuucagcugggucggcgucuuccgcaccgugccgcaccuuuuggggacgaucgcgcaccgcggggucuacuuuagcaugugcgagccgguuugcgccacguuuggcgccuccgaggucggcuugugggccuggcucuucaucaucuccaagauccccgagcucaucgacacgguuuucaucgucuugcggaagaagccgcucauuuucuugcacugguaccaccacgucacgguccuccucuacugcugggccagcuacacaacgcagaacagcgccgggcucuacuuuaucugcaugaacuacaccguccaugcaauuauguacggcuacuacuuucucaaggcggucaacauguggccgcgguucaucccgucguggaccaucacgcugcuccagcucagccagauggucggcggcaucguggucugcuaccucacguacaaguacgagaaggaggacgggcuuccgugcucgaucuccgaggucgccuucaacaccggcgucgucauguacgggagcuauuuucuccuguuccugcaaauccuguucucgcuucucucuggcggcaagaaaaagucggcaggccgucccaaggcggaugccgggcugcaacagaagaagaagcaguaggcugccgcgagcaugcguuccgcggcgcuggaaagccugaaacaugcaaugcaugcgccagucuauugcgaucugcguuggaagaaaauaaagaagaaacggacuuuaucuagaaccgaaaaaaaaaaaaaaaaaaaaaaaaaaaaauaaaaaaaaaaaaaa

SEQ ID NO: 28 - DNA, 792 bp, Thraustochytrium aureum
atggacgtctatgacgcacagccgtggaccgccgaggcgctcggccccctctgggatgacctgtacttgcttgtgcctgtctacatggtctgcgtagcagcgctgcggcgagtgggcccgtggcgagtgagcgagacgcagagcaagtcgtacaagttcaacgccgcgttttggaagcccatcatgatcgcctacaacgttgcgatgacgctgttctcgttcgtgtgctttgcaggcatggcctacgtcgtcctcgtcaagcagcagggcgagttcgcggggccggactgtcaggcatacgacaggcagccgctgttccgaaacatcgtgtacgcgttcttcgtgagcaagttcgtcgagttcgcggacacgctgttcctcatcgtcaagggcaagcctgtgtcatggctgcactttttccaccactgcggcgcagcaatcaacatgggcctgttatcgcgtagcggcatggaggcgacgtggttgtttgtcttgctgaacgggtttgtgcatacggtcatgtacacatactacggctgcgccctggcgggggtccgcctgcgcggcaagtcgctcatcacggtcatgcagatcgcgcaattcctcctcgggctttccgtgttctggcagtacaagaacgtcacctgctttagtcagagcacgccgctcatgttcaccttttggtacacttacacgtacgtcggcatcgtgctgctcttcttcctcaactttttcgcgcagagctacgtcatgccgcgcaagacaaaagcggaccagctcaagtcgcagtga

SEQ ID NO: 29 - protein, 263 aa, Thraustochytrium aureum
MDVYDAQPWTAEALGPLWDDLYLLVPVYMVCVAALRRVGPWRVSETQSKSYKFNAAFWKPIMIAYNVAMTLFSFVCFAGMAYVVLVKQQGEFAGPDCQAYDRQPLFRNIVYAFFVSKFVEFADTLFLIVKGKPVSWLHFFHHCGAAINMGLLSRSGMEATWLFVLLNGFVHTVMYTYYGCALAGVRLRGKSLITVMQIAQFLLGLSVFWQYKNVTCFSQSTPLMFTFWYTYTYVGIVLLFFLNFFAQSYVMPRKTKADQLKSQ

SEQ ID NO: 30 - RNA, 1031 nt, Thraustochytrium aureum
aucccccauugaccgauuugcagcggucggcugcucgagcgacgcagagccaagucggcgcgcggugacuuggaaauggacgucuaugacgcacagccguggaccgccgaggcgcucggcccccucugggaugaccuguacuugcuugugccugucuacauggucugcguagcagcgcugcggcgagugggcccguggcgagugagcgagacgcagagcaagucguacaaguucaacgccgcguuuuggaagcccaucaugaucgccuacaacguugcgaugacgcuguucucguucgugugcuuugcaggcauggccuacgucguccucgucaagcagcagggcgaguucgcggggccggacugucaggcauacgacaggcagccgcuguuccgaaacaucguguacgcguucuucgugagcaaguucgucgaguucgcggacacgcuguuccucaucgucaagggcaagccugugucauggcugcacuuuuuccaccacugcggcgcagcaaucaacaugggccuguuaucgcguagcggcauggaggcgacgugguuguuugucuugcugaacggguuugugcauacggucauguacacauacuacggcugcgcccuggcggggguccgccugcgcggcaagucgcucaucacggucaugcagaucgcgcaauuccuccucgggcuuuccguguucuggcaguacaagaacgucaccugcuuuagucagagcacgccgcucauguucaccuuuugguacacuuacacguacgucggcaucgugcugcucuucuuccucaacuuuuucgcgcagagcuacgucaugccgcgcaagacaaaagcggaccagcucaagucgcaguaguggucuuucgcgcccaccacggccccggcgcccacggcgaugcgccaggacugcgcucgagcaaguuuugcaucaggacaacacaaccgccucaauuguuuuuaaguuaaaaaaaaaaaaaaaaaaaaaaaaaaaaaaaaaaaaaaaaaaaaaaaaaaaaauaa

SEQ ID NO: 31 - DNA, 942 bp, Thraustochytrium aureum
atgaccgagactgtgctgtgggtgctgggcatcgtgtgggtcgtgtcgttcgcgtcgtacctcgtgccgcagctcctgctcaagctgcgcagtgtgcagaatctgaaggacaagtatggcgcaaagtgggctctggtcaccggcgggtctagcgggattggccgtgcgatcgttgagacgctcgctggccaaggcctcaacatcgtcgtcgttgccatgcaggacaaggtcctcgacacttctgtggaggagtacaagaaggcgttcccaagtgtcgaatttcgcaaggtgggggtcgacctgtcctccgcggaccgaatgcagcccatgcgtgaggcgaccaaagatatcgatgtgcaggtcatcgtgaacaacgccggctatatcaagaccggtttctttgcggagacccctttcggcgcgcagctggcgaaccacaacgtgaacgcaaccgccgccatggaggttgcccaccactacatcagcgcgatgcgggctaagggtctcaaagggtgcgtcaccttcacctcgtccccggctggattcatgccgtgccctttcagcgtcatgtacggcgcgaccaaggcgtatttgactacttttgcgcagagcctggcgccggagcttcggtgtgacgggatcgacgtttgcgttgtgcacccctcgcccgtcgcctcgagcttttacgacaatacccacgctcttgacgccctgctgttcttcaaaagcaccgcgacggggccgcagactatcgccaacatcttgctcgccaacgtcggccgagcagtcaccatcgaccagggctactacccaatctgcgtcaagctgcttcttaaagtgctcgacgtcaactttctcgccgagaccatcgcctccgtagcacactttatgcccgactttaaggccatgaagtccacctcgtcgccgaagaaggtcgcttga

SEQ ID NO: 32 - protein, 313 aa, Thraustochytrium aureum
MTETVLWVLGIVWVVSFASYLVPQLLLKLRSVQNLKDKYGAKWALVTGGSSGIGRAIVETLAGQGLNIVVVAMQDKVLDTSVEEYKKAFPSVEFRKVGVDLSSADRMQPMREATKDIDVQVIVNNAGYIKTGFFAETPFGAQLANHNVNATAAMEVAHHYISAMRAKGLKGCVTFTSSPAGFMPCPFSVMYGATKAYLTTFAQSLAPELRCDGIDVCVVHPSPVASSFYDNTHALDALLFFKSTATGPQTIANILLANVGRAVTIDQGYYPICVKLLLKVLDVNFLAETIASVAHFMPDFKAMKSTSSPKKVA

SEQ ID NO: 33 - RNA, 1246 nt, Thraustochytrium aureum
aagcuugugugagcugagcgaaggcgcgucaucgugcaggcacgaugaccgagacugugcugugggugcugggcaucgugugggucgugucguucgcgucguaccucgugccgcagcuccugcucaagcugcgcagugugcagaaucugaaggacaaguauggcgcaaagugggcucuggucaccggcgggucuagcgggauuggccgugcgaucguugagacgcucgcuggccaaggccucaacaucgucgucguugccaugcaggacaagguccucgacacuucuguggaggaguacaagaaggcguucccaagugucgaauuucgcaaggugggggucgaccuguccuccgcggaccgaaugcagcccaugcgugaggcgaccaaagauaucgaugugcaggucaucgugaacaacgccggcuauaucaagaccgguuucuuugcggagaccccuuucggcgcgcagcuggcgaaccacaacgugaacgcaaccgccgccauggagguugcccaccacuacaucagcgcgaugcgggcuaagggucucaaagggugcgucaccuucaccucguccccggcuggauucaugccgugcccuuucagcgucauguacggcgcgaccaaggcguauuugacuacuuuugcgcagagccuggcgccggagcuucggugugacgggaucgacguuugcguugugcaccccucgcccgucgccucgagcuuuuacgacaauacccacgcucuugacgcccugcuguucuucaaaagcaccgcgacggggccgcagacuaucgccaacaucuugcucgccaacgucggccgagcagucaccaucgaccagggcuacuacccaaucugcgucaagcugcuucuuaaagugcucgacgucaacuuucucgccgagaccaucgccuccguagcacacuuuaugcccgacuuuaaggccaugaaguccaccucgucgccgaagaaggucgcuugagcgcccgcacggacagaggcgccaggaucaagcaguuuccgaccccccuuugccuuuuccuacacgcaccagcgagccguccgugcguuuggacgcgcagagucucgcaggcaagcgcuucacgguccggaacgauaaauagcuucaucaccuucaacaugcgcucaacaacgauucggcgcaaagcaaagcuaaccaguaaggaccuacaaaaaaaaaaaaaaaaaaaaaaaaaaaauaaaaaaaaaaaaaaaaaaaaa

SEQ ID NO: 34 - DNA, 104 bp, Artificial Sequence
  Primer
ataaaagtatcaacaaaaaattgttaatatacctctatactttaacgtcaaggagaaaaaaccccggatcggcgcgccaccatgttcaaccaggcaagcgagct

SEQ ID NO: 35 - DNA, 101 bp, Artificial Sequence
  Primer
aactataaaaaaataaatagggacctagacttcaggttgtctaactccttccttttcggttagagcggatttaattaactagccctgcgcgttaatggctt

SEQ ID NO: 36 - DNA, 104 bp, Artificial Sequence
  Primer
ataaaagtatcaacaaaaaattgttaatatacctctatactttaacgtcaaggagaaaaaaccccggatcggcgcgccaccatggcggccaacatgtggggcca

SEQ ID NO: 37 - DNA, 101 bp, Artificial Sequence
  Primer
aactataaaaaaataaatagggacctagacttcaggttgtctaactccttccttttcggttagagcggatttaattaatcacgccaccgtgcgctcgcgca

SEQ ID NO: 38 - DNA, 104 bp, Artificial Sequence
  Primer
ataaaagtatcaacaaaaaattgttaatatacctctatactttaacgtcaaggagaaaaaaccccggatcggcgcgccaccatggcgccagcggttggcaaggc

SEQ ID NO: 39 - DNA, 101 bp, Artificial Sequence
  Primer
aactataaaaaaataaatagggacctagacttcaggttgtctaactccttccttttcggttagagcggatttaattaattgggcctttttggactcgcgct

SEQ ID NO: 40 - DNA, 104 bp, Artificial Sequence
  Primer
ataaaagtatcaacaaaaaattgttaatatacctctatactttaacgtcaaggagaaaaaaccccggatcggcgcgccaccatggcgcccccaaaggtcttctc

SEQ ID NO: 41 - DNA, 101 bp, Artificial Sequence
  Primer
aactataaaaaaataaatagggacctagacttcaggttgtctaactccttccttttcggttagagcggatttaattaatcagagcttggcgtcgcgcgggt

SEQ ID NO: 42 - DNA, 104 bp, Artificial Sequence
  Primer
ataaaagtatcaacaaaaaattgttaatatacctctatactttaacgtcaaggagaaaaaaccccggatcggcgcgccaccatgtgcaaggtcgatgggacaaa

SEQ ID NO: 43 - DNA, 101 bp, Artificial Sequence
  Primer
aactataaaaaaataaatagggacctagacttcaggttgtctaactccttccttttcggttagagcggatttaattaatcagagctttttggccgcacgct

SEQ ID NO: 44 - DNA, 104 bp, Artificial Sequence
  Primer
ataaaagtatcaacaaaaaattgttaatatacctctatactttaacgtcaaggagaaaaaaccccggatcggcgcgccaccatggcgacgcgcacctcgaagag

SEQ ID NO: 45 - DNA, 101 bp, Artificial Sequence
  Primer
aactataaaaaaataaatagggacctagacttcaggttgtctaactccttccttttcggttagagcggatttaattaatcactcggacttggtgggggcgc

SEQ ID NO: 46 - DNA, 104 bp, Artificial Sequence
  Primer
ataaaagtatcaacaaaaaattgttaatatacctctatactttaacgtcaaggagaaaaaaccccggatcggcgcgccaccatggccgcggccttcatggactt

SEQ ID NO: 47 - DNA, 101 bp, Artificial Sequence
  Primer
aactataaaaaaataaatagggacctagacttcaggttgtctaactccttccttttcggttagagcggatttaattaatcactccaccttggccttgggcc

SEQ ID NO: 48 - DNA, 104 bp, Artificial Sequence
  Primer
ataaaagtatcaacaaaaaattgttaatatacctctatactttaacgtcaaggagaaaaaaccccggatcggcgcgccaccatggaaaatacaatggagcacaa

SEQ ID NO: 49 - DNA, 101 bp, Artificial Sequence
  Primer
aactataaaaaaataaatagggacctagacttcaggttgtctaactccttccttttcggttagagcggatttaattaatcaggtcgacttgagcttgtcgg

SEQ ID NO: 50 - DNA, 104 bp, Artificial Sequence
  Primer
ataaaagtatcaacaaaaaattgttaatatacctctatactttaacgtcaaggagaaaaaaccccggatcggcgcgccaccatgcgcaccgcgtacgaagcagc

SEQ ID NO: 51 - DNA, 101 bp, Artificial Sequence
  Primer
aactataaaaaaataaatagggacctagacttcaggttgtctaactccttccttttcggttagagcggatttaattaactactgcttcttcttctgttgca

SEQ ID NO: 52 - DNA, 104 bp, Artificial Sequence
  Primer
ataaaagtatcaacaaaaaattgttaatatacctctatactttaacgtcaaggagaaaaaaccccggatcggcgcgccaccatggacgtctatgacgcacagcc

SEQ ID NO: 53 - DNA, 101 bp, Artificial Sequence
  Primer
aactataaaaaaataaatagggacctagacttcaggttgtctaactccttccttttcggttagagcggatttaattaatcactgcgacttgagctggtccg

SEQ ID NO: 54 - DNA, 104 bp, Artificial Sequence
  Primer
ataaaagtatcaacaaaaaattgttaatatacctctatactttaacgtcaaggagaaaaaaccccggatcggcgcgccaccatgaccgagactgtgctgtgggt

SEQ ID NO: 55 - DNA, 101 bp, Artificial Sequence
  Primer
aactataaaaaaataaatagggacctagacttcaggttgtctaactccttccttttcggttagagcggatttaattaatcaagcgaccttcttcggcgacg

SEQ ID NO: 56 - DNA, 1197 bp, Phytophthora soja
atggcaattctgaatccggaagcagatagcgcagcaaatctggcaaccgattcagaagcaaaacagcgtcagctggccgaagcaggttatacccatgttgaaggtgcaccggcaccgctgccgctggaactgccgcatttttcactgcgtgatctgcgtgcagcaattccgaaacattgttttgaacgtagctttgttaccagcacctattatatgattaaaaacgtgctgacctgcgcagcactgttttatgcagcaacctttattgatcgtgctggtgcagcagcctatgttctgtggcctgtttattggttttttcagggttcatatctgaccggtgtttgggttattgcacatgaatgtggtcatcaggcctattgtagctcagaagttgtgaataatctgattggtctggttctgcattcagcactgctggttccgtatcattcttggcgtattagccatcgtaaacatcattcaaataccggtagctgcgaaaatgatgaagtttttgttccggttacccgtagcgttctggcaagcagctggaatgaaaccctggaagatagtccgctgtatcagctgtatcgtattgtttatatgctggttgttggttggatgccgggttacctgttttttaatgcaaccggtccgaccaaatattggggtaaatcacgtagccattttaatccgtatagcgcaatttatgccgatcgtgaacgttggatgattgttctgtcagatatttttctggttgcaatgctggcagttctggcagcactggttcatacctttagctttaatacgatggtgaagttttatgtggtgccgtattttattgtgaatgcctatctggtgctgattacctatctgcagcacaccgatacctatattccgcactttcgtgaaggtgaatggaattggctgcgtggtgcactgtgtaccgttgatcgtagctttggtccgtttctggattcagttgttcatcgtattgttgatacccatgtgtgccatcatatttttagcaaaatgccgttttatcattgcgaagaagccaccaacgcaattaaaccgctgctgggtaaattttatctgaaagataccacaccggttccggttgcactgtggcgttcatatacccattgtaaatttgtggaagatgatggcaaagtggtgttttacaaaaacaaactgtaa

SEQ ID NO: 57 - protein, 398 aa, Phytophthora soja
MAILNPEADSAANLATDSEAKQRQLAEAGYTHVEGAPAPLPLELPHFSLRDLRAAIPKHCFERSFVTSTYYMIKNVLTCAALFYAATFIDRAGAAAYVLWPVYWFFQGSYLTGVWVIAHECGHQAYCSSEVVNNLIGLVLHSALLVPYHSWRISHRKHHSNTGSCENDEVFVPVTRSVLASSWNETLEDSPLYQLYRIVYMLVVGWMPGYLFFNATGPTKYWGKSRSHFNPYSAIYADRERWMIVLSDIFLVAMLAVLAALVHTFSFNTMVKFYVVPYFIVNAYLVLITYLQHTDTYIPHFREGEWNWLRGALCTVDRSFGPFLDSVVHRIVDTHVCHHIFSKMPFYHCEEATNAIKPLLGKFYLKDTTPVPVALWRSYTHCKFVEDDGKVVFYKNKL

SEQ ID NO: 58 - DNA, 1371 bp, Ostreococcus tauri
atgtgtgttgagaccgagaacaacgatggaatccctactgtggagatcgctttcgatggagagagagaaagagctgaggctaacgtgaagttgtctgctgagaagatggaacctgctgctttggctaagaccttcgctagaagatacgtggttatcgagggagttgagtacgatgtgaccgatttcaaacaccctggaggaaccgtgattttctacgctctctctaacactggagctgatgctactgaggctttcaaggagttccaccacagatctagaaaggctaggaaggctttggctgctttgccttctagacctgctaagaccgctaaagtggatgatgctgagatgctccaggatttcgctaagtggagaaaggagttggagagggacggattcttcaagccttctcctgctcacgttgcttacagattcgctgagttggctgctatgtacgctttgggaacctacttgatgtacgctagatacgttgtgtcctctgtgttggtttacgcttgcttcttcggagctagatgtggatgggttcaacacgagggaggacactcttctttgaccggaaacatctggtgggataagagaatccaagctttcactgctggattcggattggctggatctggagatatgtggaactccatgcacaacaagcaccacgctactcctcaaaaagtgaggcacgatatggatttggataccactcctgctgttgctttcttcaacaccgctgtggaggataatagacctaggggattctctaagtactggctcagattgcaagcttggaccttcattcctgtgacttctggattggtgttgctcttctggatgttcttcctccacccttctaaggctttgaagggaggaaagtacgaggagcttgtgtggatgttggctgctcacgtgattagaacctggaccattaaggctgttactggattcaccgctatgcaatcctacggactcttcttggctacttcttgggtttccggatgctacttgttcgctcacttctctacttctcacacccacttggatgttgttcctgctgatgagcacttgtcttgggttaggtacgctgtggatcacaccattgatatcgatccttctcagggatgggttaactggttgatgggatacttgaactgccaagtgattcaccacctcttcccttctatgcctcaattcagacaacctgaggtgtccagaagattcgttgctttcgctaagaagtggaacctcaactacaaggtgatgacttatgctggagcttggaaggctactttgggaaacctcgataatgtgggaaagcactactacgtgcacggacaacactctggaaagaccgcttga

SEQ ID NO: 59 - protein, 456 aa, Ostreococcus tauri
MCVETENNDGIPTVEIAFDGERERAEANVKLSAEKMEPAALAKTFARRYVVIEGVEYDVTDFKHPGGTVIFYALSNTGADATEAFKEFHHRSRKARKALAALPSRPAKTAKVDDAEMLQDFAKWRKELERDGFFKPSPAHVAYRFAELAAMYALGTYLMYARYVVSSVLVYACFFGARCGWVQHEGGHSSLTGNIWWDKRIQAFTAGFGLAGSGDMWNSMHNKHHATPQKVRHDMDLDTTPAVAFFNTAVEDNRPRGFSKYWLRLQAWTFIPVTSGLVLLFWMFFLHPSKALKGGKYEELVWMLAAHVIRTWTIKAVTGFTAMQSYGLFLATSWVSGCYLFAHFSTSHTHLDVVPADEHLSWVRYAVDHTIDIDPSQGWVNWLMGYLNCQVIHHLFPSMPQFRQPEVSRRFVAFAKKWNLNYKVMTYAGAWKATLGNLDNVGKHYYVHGQHSGKTA

SEQ ID NO: 60 - DNA, 819 bp, Thalassiosira pseudonana
atggatgcttataacgctgctatggataagattggagctgctatcatcgattggagtgatccagatggaaagttcagagctgatagggaggattggtggttgtgcgatttcagatccgctatcaccattgctctcatctacatcgctttcgtgatcttgggatctgctgtgatgcaatctctcccagctatggacccataccctatcaagttcctctacaacgtgtctcaaatcttcctctgcgcttacatgactgttgaggctggattcctcgcttataggaacggatacaccgttatgccatgcaaccacttcaacgtgaacgatccaccagttgctaacttgctctggctcttctacatctccaaagtgtgggatttctgggataccatcttcattgtgctcggaaagaagtggagacaactctctttcttgcacgtgtaccaccacaccaccatcttcctcttctactggttgaacgctaacgtgctctacgatggagatatcttcttgaccatcctcctcaacggattcattcacaccgtgatgtacacctactacttcatctgcatgcacaccaaggattctaagaccggaaagtctttgccaatctggtggaagtcatctttgaccgctttccaactcttgcaattcaccatcatgatgtcccaagctacctacttggttttccacggatgcgataaggtttccctcagaatcaccatcgtgtacttcgtgtacattctctcccttttcttcctcttcgctcagttcttcgtgcaatcctacatggctccaaagaagaagaagtccgcttga

SEQ ID NO: 61 - protein, 272 aa, Thalassiosira pseudonana
MDAYNAAMDKIGAAIIDWSDPDGKFRADREDWWLCDFRSAITIALIYIAFVILGSAVMQSLPAMDPYPIKFLYNVSQIFLCAYMTVEAGFLAYRNGYTVMPCNHFNVNDPPVANLLWLFYISKVWDFWDTIFIVLGKKWRQLSFLHVYHHTTIFLFYWLNANVLYDGDIFLTILLNGFIHTVMYTYYFICMHTKDSKTGKSLPIWWKSSLTAFQLLQFTIMMSQATYLVFHGCDKVSLRITIVYFVYILSLFFLFAQFFVQSYMAPKKKKSA

SEQ ID NO: 62 - DNA, 873 bp, Physcomitrella patens
atggaagttgttgagaggttctacggagagttggatggaaaggtttcccaaggagtgaacgctttgttgggatctttcggagttgagttgactgataccccaactactaagggattgccactcgttgattctccaactccaattgtgttgggagtgtctgtttacttgaccatcgtgatcggaggattgctttggatcaaggctagagatctcaagccaagagcttctgagccattcttgttgcaagctttggtgttggtgcacaacttgttctgcttcgctttgtctctttacatgtgtgtgggaatcgcttaccaagctatcacctggagatattccttgtggggaaacgcttataacccaaagcacaaggagatggctatcctcgtttacctcttctacatgtccaagtacgtggagttcatggataccgtgatcatgatcctcaagagatctaccagacagatttctttcctccacgtgtaccaccactcttctatctcccttatctggtgggctattgctcaccacgctccaggaggagaggcttattggagcgctgctctcaactctggagtgcacgtgttgatgtacgcttactacttcttggctgcttgcttgagatcttccccaaagctcaagaacaagtacctcttctggggaagatacctcacccaattccagatgttccagtttatgctcaacttggtgcaagcttactacgatatgaagaccaacgctccatatccacagtggctcatcaagatcctcttctactacatgatctccctcttgttcctcttcggaaacttctacgtgcaaaagtacatcaagccatcagatggaaagcaaaagggagctaagaccgagtga

SEQ ID NO: 63 - protein, 290 aa, Physcomitrella patens
MEVVERFYGELDGKVSQGVNALLGSFGVELTDTPTTKGLPLVDSPTPIVLGVSVYLTIVIGGLLWIKARDLKPRASEPFLLQALVLVHNLFCFALSLYMCVGIAYQAITWRYSLWGNAYNPKHKEMAILVYLFYMSKYVEFMDTVIMILKRSTRQISFLHVYHHSSISLIWWAIAHHAPGGEAYWSAALNSGVHVLMYAYYFLAACLRSSPKLKNKYLFWGRYLTQFQMFQFMLNLVQAYYDMKTNAPYPQWLIKILFYYMISLLFLFGNFYVQKYIKPSDGKQKGAKTE

SEQ ID NO: 64 - DNA, 1320 bp, Thraustochytrium sp.
atgggaaaaggatctgagggaagatctgctgctagagagatgactgctgaggctaacggagataagagaaagaccatcctcattgagggagtgttgtacgatgctaccaacttcaaacacccaggaggttccattattaacttcctcaccgagggagaagctggagttgatgctacccaagcttacagagagttccatcagagatccggaaaggctgataagtacctcaagtccctcccaaagttggatgcttctaaggtggagtctaggttctctgctaaggagcaggctagaagggacgctatgaccagggattacgctgctttcagagaggagttggttgctgagggatacttcgatccatctatcccacacatgatctacagagtggtggagattgtggctttgttcgctttgtctttctggttgatgtctaaggcttctccaacctctttggttttgggagtggtgatgaacggaatcgctcaaggaagatgcggatgggttatgcacgagatgggacacggatctttcactggagttatctggctcgatgataggatgtgcgagttcttctacggagttggatgtggaatgtctggacactactggaagaaccagcactctaagcaccacgctgctccaaacagattggagcacgatgtggatttgaacaccttgccactcgttgctttcaacgagagagttgtgaggaaggttaagccaggatctttgttggctttgtggctcagagttcaggcttatttgttcgctccagtgtcttgcttgttgatcggattgggatggaccttgtacttgcacccaagatatatgctcaggaccaagagacacatggagtttgtgtggatcttcgctagatatatcggatggttctccttgatgggagctttgggatattctcctggaacttctgtgggaatgtacctctgctctttcggacttggatgcatctacatcttcctccaattcgctgtgtctcacacccacttgccagttaccaacccagaggatcaattgcactggcttgagtacgctgctgatcacaccgtgaacatctctaccaagtcttggttggttacctggtggatgtctaacctcaacttccaaatcgagcaccacttgttcccaaccgctccacaattcaggttcaaggagatctctccaagagttgaggctctcttcaagagacacaacctcccttactacgatttgccatacacctctgctgtttctactaccttcgctaacctctactctgttggacactctgttggagctgataccaagaagcaggattga

SEQ ID NO: 65 - protein, 439 aa, Thraustochytrium sp.
MGKGSEGRSAAREMTAEANGDKRKTILIEGVLYDATNFKHPGGSIINFLTEGEAGVDATQAYREFHQRSGKADKYLKSLPKLDASKVESRFSAKEQARRDAMTRDYAAFREELVAEGYFDPSIPHMIYRVVEIVALFALSFWLMSKASPTSLVLGVVMNGIAQGRCGWVMHEMGHGSFTGVIWLDDRMCEFFYGVGCGMSGHYWKNQHSKHHAAPNRLEHDVDLNTLPLVAFNERVVRKVKPGSLLALWLRVQAYLFAPVSCLLIGLGWTLYLHPRYMLRTKRHMEFVWIFARYIGWFSLMGALGYSPGTSVGMYLCSFGLGCIYIFLQFAVSHTHLPVTNPEDQLHWLEYAADHTVNISTKSWLVTWWMSNLNFQIEHHLFPTAPQFRFKEISPRVEALFKRHNLPYYDLPYTSAVSTTFANLYSVGHSVGADTKKQD

SEQ ID NO: 66 - DNA, 792 bp, Isochrysis galbana
atggccctcgcaaacgacgcgggagagcgcatctgggcggctgtgaccgacccggaaatcctcattggcaccttctcgtacttgctactcaaaccgctgctccgcaattccgggctggtggatgagaagaagggcgcatacaggacgtccatgatctggtacaacgttctgctggcgctcttctctgcgctgagcttctacgtgacggcgaccgccctcggctgggactatggtacgggcgcgtggctgcgcaggcaaaccggcgacacaccgcagccgctcttccagtgcccgtccccggtttgggactcgaagctcttcacatggaccgccaaggcattctattactccaagtacgtggagtacctcgacacggcctggctggtgctcaagggcaagagggtctcctttctccaggccttccaccactttggcgcgccgtgggatgtgtacctcggcattcggctgcacaacgagggcgtatggatcttcatgtttttcaactcgttcattcacaccatcatgtacacctactacggcctcaccgccgccgggtataagttcaaggccaagccgctcatcaccgcgatgcagatctgccagttcgtgggcggcttcctgttggtctgggactacatcaacgtcccctgcttcaactcggacaaagggaagttgttcagctgggctttcaactatgcatacgtcggctcggtcttcttgctcttctgccactttttctaccaggacaacttggcaacgaagaaatcggccaaggcgggcaagcagctctag

SEQ ID NO: 67 - protein, 263 aa, Isochrysis galbana
MALANDAGERIWAAVTDPEILIGTFSYLLLKPLLRNSGLVDEKKGAYRTSMIWYNVLLALFSALSFYVTATALGWDYGTGAWLRRQTGDTPQPLFQCPSPVWDSKLFTWTAKAFYYSKYVEYLDTAWLVLKGKRVSFLQAFHHFGAPWDVYLGIRLHNEGVWIFMFFNSFIHTIMYTYYGLTAAGYKFKAKPLITAMQICQFVGGFLLVWDYINVPCFNSDKGKLFSWAFNYAYVGSVFLLFCHFFYQDNLATKKSAKAGKQL

SEQ ID NO: 68 - DNA, 1236 bp, Perkinsus marinus
atgtcttctcttaccctctacagaggccccttttcccgaatggtgctccctcgtcaggaaatctgcatcgatggtcgcatatacgatgtcactgagttcatcaatcgtcatccaggtggtaagattatcctcttccaagttggtgctgatgccactgatgcttttcgtgagtttcatgctggcagtgagaaggcagagaagatcctcaaaaccctaccatcccgtgatgatgacggtactttccttccttcaacccaacgctccatcatggatgatttcaaacgcctaagagatgacctcgtcagcagaggtgtcttcaagccaagcgtcatgcatgttgtataccgctgcttggaagtcgttgctctctatctcattggcttctatttggctctgtgcaccagtaatgtgtacgttgggtgtgctgtacttggtgtagctcaaggtcgtgctggttggttgatgcatgaaggaggtcatcactctctgactggtaactggaaagttgaccagttcctccaagaactatttttcggcattggttgtggtatgtcagctgcgtggtggcgcaatgcacacaacaagcatcacgctgctcctcagcatttagggaaagatgttgatctcgagacattgcctctggtcgccttcaataaggccgtacttcgaggccgtctaccgtctgtctggatcagatcacaagctgtgtgctttgcaccgatatcaacactactggtatcgttcttttggcaattctacctacacccgaggcatattattaggacaggtcgacgaatggagtctttctggctactcgtacgctacttagttattgtgtacctcgggttcagctatggattggtatcggtcttgttatgttacatcgcaagtgtgcatgttggtggtatgtacatctttgtacacttcgctctatcacatacacatttacctgtcattaaccagcatggtagagctaactggttggaatacgcatctaagcacacagttaatgtgtcaactaacaattatttcgtcacatggctcatgagttatttgaattatcaaatagagcatcatctcttcccgtcatgtccccagtttagattccctggttacgtcagtatgagggttcgagaattttttcataagcatggattgaagtataacgaggtcggctatctacatgcactcaatctcacattttcaaatctggctgctgttgccatagtggaatag

SEQ ID NO: 69 - protein, 411 aa, Perkinsus marinus
MSSLTLYRGPFSRMVLPRQEICIDGRIYDVTEFINRHPGGKIILFQVGADATDAFREFHAGSEKAEKILKTLPSRDDDGTFLPSTQRSIMDDFKRLRDDLVSRGVFKPSVMHVVYRCLEVVALYLIGFYLALCTSNVYVGCAVLGVAQGRAGWLMHEGGHHSLTGNWKVDQFLQELFFGIGCGMSAAWWRNAHNKHHAAPQHLGKDVDLETLPLVAFNKAVLRGRLPSVWIRSQAVCFAPISTLLVSFFWQFYLHPRHIIRTGRRMESFWLLVRYLVIVYLGFSYGLVSVLLCYIASVHVGGMYIFVHFALSHTHLPVINQHGRANWLEYASKHTVNVSTNNYFVTWLMSYLNYQIEHHLFPSCPQFRFPGYVSMRVREFFHKHGLKYNEVGYLHALNLTFSNLAAVAIVE

SEQ ID NO: 70 - DNA, 1128 bp, Helobdella robusta
atgaattgtgttaccgaggtgaacagcatcattgctagccttatcaaggctgctttcctctactctaaccctcagaccaagatcagaggtatcaaccttgatacccagcttcctaagaacctcccttctgtgatcgagatcaagagggttatcccttctcattgcttcgttccttctacctgccgttctcttctttacgctctcaaggacgttgttcagatccttttcgcttgggttctcctttggtacttgcttcctctcactaactggatcgctctcaaggttctcatgatcttcgtgtactggggaatccagggaactttcttcatgggactcttcgttatgggacatgattgtggacacggaagcttctctaagtaccgtcttttgaacgatgttgtgggaactatctctcacgctttcctcttcgtgccttactaccagtggaagcttactcatcagaaccaccacaagttcaccggaaacatggataaggacgaggttttctaccctgctagagcttctcaaaagcctagcatcaactctgttctccctggattcggatacggaatcggatggttcacttacctcttcatcggatacttccctagaagagtgtctcacttcaacctcttcgacgagatgttcagaggacatgaagttgcttgcaccctttctcttctcacctacggaatgaacggaactctttgctactggttctacctcagctacggattcaagatcctcttcgtgttctaccttgctcctctcttcatctacggaagctacatggttatcgtgactttccttcaccactctgaggttaacatcccttggtacgctgatcaaaactggaactacgtgaagggacagctttctaccatcgacagaaactacggacttgttcaccatgctatccactgtatcggaactcatcagatgcatcacatgttcaccaagatccctcattaccaccttgaggaagctactagacacttccgttctgctttccctgagcttgttaagtcttgcgacgagcctatcctctcttctttcgtccgtatgttcaagaagtacaaccagcaacaggttgtggctgataacgctctcgaggtgtactacaagtga

SEQ ID NO: 71 - protein, 375 aa, Helobdella robusta
MNCVTEVNSIIASLIKAAFLYSNPQTKIRGINLDTQLPKNLPSVIEIKRVIPSHCFVPSTCRSLLYALKDVVQILFAWVLLWYLLPLTNWIALKVLMIFVYWGIQGTFFMGLFVMGHDCGHGSFSKYRLLNDVVGTISHAFLFVPYYQWKLTHQNHHKFTGNMDKDEVFYPARASQKPSINSVLPGFGYGIGWFTYLFIGYFPRRVSHFNLFDEMFRGHEVACTLSLLTYGMNGTLCYWFYLSYGFKILFVFYLAPLFIYGSYMVIVTFLHHSEVNIPWYADQNWNYVKGQLSTIDRNYGLVHHAIHCIGTHQMHHMFTKIPHYHLEEATRHFRSAFPELVKSCDEPILSSFVRMFKKYNQQQVVADNALEVYYK

SEQ ID NO: 72 - DNA, 1086 bp, Phytophthora infestans
atggcgacgaaggaggcgtatgtgttccccactctgacggagatcaagcggtcgctacctaaagactgtttcgaggcttcggtgcctctgtcgctctactacaccgtgcgttgtctggtgatcgcggtggctctaaccttcggtctcaactacgctcgcgctctgcccgaggtcgagagcttctgggctctggacgccgcactctgcacgggctacatcttgctgcagggcatcgtgttctggggcttcttcacggtgggccacgatgccggccacggcgccttctcgcgctaccacctgcttaacttcgtggtgggcactttcatgcactcgctcatcctcacgcccttcgagtcgtggaagctcacgcaccgtcaccaccacaagaacacgggcaacattgaccgtgacgaggtcttctacccgcaacgcaaggccgacgaccacccgctgtctcgcaacctgattctggcgctcggggcagcgtggctcgcctatttggtcgagggcttccctcctcgtaaggtcaaccacttcaacccgttcgagcctctgttcgtgcgtcaggtgtcagctgtggtaatctctcttctcgcccacttcttcgtggccggactctccatctatctgagcctccagctgggccttaagacgatggcaatctactactatggacctgtttttgtgttcggcagcatgctggtcattaccaccttcctacaccacaatgatgaggagaccccatggtacgccgactcggagtggacgtacgtcaagggcaacctctcgtccgtggaccgatcgtacggcgcgctcattgacaacctgagccacaacatcggcacgcaccagatccaccaccttttccctatcattccgcactacaaactcaagaaagccactgcggccttccaccaggctttccctgagctcgtgcgcaagagcgacgagccaattatcaaggctttcttccgggttggacgtctctacgcaaactacggcgttgtggaccaggaggcgaagctcttcacgctaaaggaagccaaggcggcgaccgaggcggcggccaagaccaagtccacgtaa

SEQ ID NO: 73 - protein, 361 aa, Phytophthora infestans
MATKEAYVFPTLTEIKRSLPKDCFEASVPLSLYYTVRCLVIAVALTFGLNYARALPEVESFWALDAALCTGYILLQGIVFWGFFTVGHDAGHGAFSRYHLLNFVVGTFMHSLILTPFESWKLTHRHHHKNTGNIDRDEVFYPQRKADDHPLSRNLILALGAAWLAYLVEGFPPRKVNHFNPFEPLFVRQVSAVVISLLAHFFVAGLSIYLSLQLGLKTMAIYYYGPVFVFGSMLVITTFLHHNDEETPWYADSEWTYVKGNLSSVDRSYGALIDNLSHNIGTHQIHHLFPIIPHYKLKKATAAFHQAFPELVRKSDEPIIKAFFRVGRLYANYGVVDQEAKLFTLKEAKAATEAAAKTKST

SEQ ID NO: 74 - DNA, 903 bp, Ostreococcus tauri
atgagcgcctccggtgcgctgctgcccgcgatcgcgttcgccgcgtacgcgtacgcgacgtacgcctacgcctttgagtggtcgcacgcgaatggcatcgacaacgtcgacgcgcgcgagtggatcggtgcgctgtcgttgaggctcccggcgatcgcgacgacgatgtacctgttgttctgcctggtcggaccgaggttgatggcgaagcgcgaggcgttcgacccgaaggggttcatgctggcgtacaatgcgtatcagacggcgttcaacgtcgtcgtgctcgggatgttcgcgcgagagatctcggggctggggcagcccgtgtgggggtcaaccatgccgtggagcgatagaaaatcgtttaagatcctcctcggggtgtggttgcactacaacaaccaatatttggagctattggacactgtgttcatggttgcgcgcaagaagacgaagcagttgagcttcttgcacgtttatcatcacgccctgttgatctgggcgtggtggttggtgtgtcacttgatggccacgaacgattgtatcgatgcctacttcggcgcggcgtgcaactcgttcattcacatcgtgatgtactcgtattatctcatgtcggcgctcggcattcgatgcccgtggaagcgatacatcacccaggctcaaatgctccaattcgtcattgtcttcgcgcacgccgtgttcgtgctgcgtcagaagcactgcccggtcacccttccttgggcgcaaatgttcgtcatgacgaacatgctcgtgctcttcgggaacttctacctcaaggcgtactcgaacaagtcgcgcggcgacggcgcgagttccgtgaaaccagccgagaccacgcgcgcgcccagcgtgcgacgcacgcgatctcgaaaaattgactaa

SEQ ID NO: 75 - protein, 300 aa, Ostreococcus tauri
MSASGALLPAIAFAAYAYATYAYAFEWSHANGIDNVDAREWIGALSLRLPAIATTMYLLFCLVGPRLMAKREAFDPKGFMLAYNAYQTAFNVVVLGMFAREISGLGQPVWGSTMPWSDRKSFKILLGVWLHYNNQYLELLDTVFMVARKKTKQLSFLHVYHHALLIWAWWLVCHLMATNDCIDAYFGAACNSFIHIVMYSYYLMSALGIRCPWKRYITQAQMLQFVIVFAHAVFVLRQKHCPVTLPWAQMFVMTNMLVLFGNFYLKAYSNKSRGDGASSVKPAETTRAPSVRRTRSRKID

SEQ ID NO: 76 - DNA, 1560 bp, Thraustochytrium sp.
atgactgttggatacgacgaggagatcccattcgagcaagttagggctcataacaagccagacgacgcttggtgtgctattcacggacacgtgtacgacgttaccaagttcgcttcagttcacccaggaggagatattatcttgctcgctgctggaaaggaagctactgtcctctacgagacctaccatgttagaggagtgtctgacgctgtgctcagaaagtacagaataggaaagttgccagacggacaaggaggagctaacgagaaggagaagagaaccttgtctggattgtcctctgcttcttactacacctggaactccgatttctacagagtgatgagggagagagttgtggctagattgaaggagagaggaaaggctagaagaggaggatacgaactctggatcaaggctttcttgctccttgttggattctggtcctctctttactggatgtgcaccctcgatccatctttcggagctatcttggctgctatgtctttgggagtgttcgctgcttttgttggaacctgcatccaacacgatggaaaccacggagctttcgctcaatctagatgggttaacaaggtggcaggatggactttggatatgatcggagcttctggaatgacttgggagttccaacacgtgttgggacaccacccatacactaacttgatcgaggaggagaacggattgcaaaaggtgtccggaaagaagatggataccaagttggctgatcaagagtctgatccagatgtgttctccacctacccaatgatgagattgcacccttggcaccagaagaggtggtatcacaggttccagcacatctacggacctttcatcttcggattcatgaccatcaacaaggtggtgactcaagatgttggagtggtgttgagaaagagactcttccaaatcgatgctgagtgcagatatgcttccccaatgtacgttgctaggttctggattatgaaggctttgaccgtgttgtatatggttgctttgccttgttatatgcaaggaccttggcacggattgaaactcttcgctatcgctcacttcacttgcggagaggttttggctaccatgttcatcgtgaaccacattatcgagggagtgtcttacgcttctaaggatgctgttaagggaactatggctccaccaaagactatgcacggagtgaccccaatgaacaacactagaaaggaggttgaggctgaggcttctaagtctggagctgtggttaagtctgtgccattggatgattgggctgctgttcagtgccaaacctctgtgaactggtctgttggatcttggttttggaaccacttctctggaggactcaaccaccaaatcgagcaccacctcttcccaggattgtctcacgagacctactaccacatccaagacgtggttcaatctacctgtgctgagtacggagttccataccaacacgagccatctttgtggactgcttactggaagatgctcgaacaccttagacaattgggaaacgaggagactcacgagtcatggcagagagctgcttga

SEQ ID NO: 77 - protein, 309 aa, Thraustochytrium sp.
MTWEFQHVLGHHPYTNLIEEENGLQKVSGKKMDTKLADQESDPDVFSTYPMMRLHPWHQKRWYHRFQHIYGPFIFGFMTINKVVTQDVGVVLRKRLFQIDAECRYASPMYVARFWIMKALTVLYMVALPCYMQGPWHGLKLFAIAHFTCGEVLATMFIVNHIIEGVSYASKDAVKGTMAPPKTMHGVTPMNNTRKEVEAEASKSGAVVKSVPLDDWAAVQCQTSVNWSVGSWFWNHFSGGLNHQIEHHLFPGLSHETYYHIQDVVQSTCAEYGVPYQHEPSLWTAYWKMLEHLRQLGNEETHESWQRAA

SEQ ID NO: 78 - DNA, 942 bp, Sphaeroforma arctica; identical to SEQ ID NO: 31

SEQ ID NO: 79 - protein, 445 aa, Sphaeroforma arctica
MPPHSRTKVVSDSDPELSDLKMKHFTREEILNHTNDKYCILEDGVYDLTNFRDKHPGGDVLDFFPGQDATPHFYMLHQYESLPSVLAEYKVGSVARDDSYVYHTPLMKQIKSAVRKVMPMQEWWAPPSWYIKACAILAATLYTDYLWIASGPTIPLAIVSGLLYAAIGLNIQHDANHGSVSRNPMVNRLFGYSQDWIGGSRMLWIRQHVVGHHTHCNRHQHDPDVKGGSVITLSRYSLPKEFHHIQQYYFLPLIQLLGFQWVFLGLHDLIEMKYKGEKLPESYRKERNIAIGLRVFFFIRKFVVPFALHFSWYTLLCTYLWMAIAALYLGFFFILSHIFVGAKSLPEDAKNIDWARHQIESSSNVCGEKLGISNGGLNYQIEHHLFPRMSHAHYSKIQPVVQKVCEENGVNYKKFGTILSNLDSTFRQVKALGSVAVYNEFMEGL

SEQ ID NO: 80 - DNA, 1453 bp, Sphaeroforma arctica
taccaagaaccggaaaaactagcagctgtaatacgactcactatagggaatattaagctcgccctttgacgacatgcctcctcacagtagaaccaaggtggtcagtgactcagatcccgagcttagtgatctgaagatgaagcacttcacgcgagaagagatcctcaaccacaccaatgacaagtactgcatcttggaggatggtgtgtatgatctcacgaacttcagggataagcatcctggtggcgatgttctggacttctttcccggacaggatgccacacctcacttctacatgctgcaccaatacgaatcgctaccgtctgttctggccgagtacaaggtgggcagtgtagccagagatgacagctatgtgtaccacacaccgctgatgaagcagatcaagtctgcagtgcgcaaggtcatgcccatgcaagaatggtgggcgcccccgtcgtggtacatcaaagcctgtgctattctagcagcaaccctctacacggactacttgtggattgcgtctgggcccaccattccgttggcgatcgtttccggtctgctgtacgccgcaattggcttaaacattcagcacgatgccaaccacgggtccgtgagcaggaatcccatggttaatcgattattcggttactctcaggattggatcgggggatcgcgtatgctgtggatccgccagcatgttgttggtcaccatacacactgcaataggcatcagcatgacccagatgtaaagggcggctcagtcatcactctgtcgcggtattctctgcccaaggaattccaccacatccagcagtactacttcctgccgttgatccaactgctcggattccaatgggtgttcctggggttgcacgacctgattgagatgaagtacaagggagaaaagctgccggagagctaccgaaaggagcgaaacatcgctatcggccttcgtgttttttttttcatccgtaaattcgttgtaccgtttgccctgcatttctcgtggtacacgctcctctgcacctacctgtggatggccattgctgctctgtacctgggcttcttcttcattctgtcgcacatcttcgtgggggctaagtcgttgccggaggatgccaagaacattgattgggctaggcatcaaatcgagtcgtcctcgaacgtctgcggagagaagcttggcatctccaacggcggcctgaactatcagattgagcatcacttgttccccaggatgagtcatgcgcactacagcaagatacagccggtggtgcagaaggtgtgtgaggagaacggggtgaactacaagaagttcggtaccatcctcagcaatctggactcgaccttccgacaggtgaaggcgttgggatcggttgcggtgtacaacgagtttatggaaggcttgtgagctgtgagtaaagggcgagctcgagtcactcatgaaagccca

SEQ ID NO: 81 - DNA, 104 bp, Artificial Sequence; identical to SEQ ID NO: 54
  Primer

SEQ ID NO: 82 - DNA, 101 bp, Artificial Sequence; identical to SEQ ID NO: 55
  Primer

SEQ ID NO: 83 - DNA, 2055 bp, Sphaeroforma arctica
  misc_feature: fatty acyl CoA synthetase
atgggaaactttctatcatcagaagcccctgccggcgaggcgtccggatacctataccccgacccaagcgacccgaaattgaaggcgcagagtgtgatagcaccgggtggtaactggggtgcagatgctcaccgctgtcccaaatatgttgatggcaaagccgaatggactgaccttatcacatccggcacacccggtcgcgagacctgctacgcgaacttccaagcgacggccaaagaacagggggacaagccatggctgggcactcgtaaggtgctttctgacggaaagcccggaccttacgagttcatcacatacggcgaaggcgctaagctggccgagcagatcggaagtggtctaatgaagttgggtgttgcgcctaagagcccttttggagtatattccaagaatcgtaccgagtggctacttgctgaacaaggagctaactgctacagcatccccaccgtagccatctacgacaccctgggcgcagattcagtgcactacgtaatggagcactctgagatggttggcgctttcttcgagagcaagcaactgtcagttgtattgggagccatcaagaagggcttgccaaacttcaaggttgcaattagtttcgatgaggtcaccgaagaggataaggaagactacaaggatgtcggcgttgatctctacccgatcaccgagttatatgccttgggcaaggataatatcgttcctcaccagcctcccggcccggatgatttgcacattcttatgtacacatccggtaccacaggcgctcctaagggtgtcatgatcactcaccgcagtatagtgtcactgcttgtggggcttgctaacgttatggctttgactagtaatgatgtccacttctccttcttgccgctggcccatattttcgagcgtttgactcagacatactgtgtgcgatgggcctgctcagtcggattcttccgtggtgtcatccccgagcttatggcggacgtgcaggctctgcgacccacctactttgttgccgtacctcgtgtgctaacacgcatctatgacaagatcatccagggtgttaaggccgctggaggagtcaaggagattctcttcaacaaggcatttgctgccagagatgccgctctaaagaacggagaagacacacctatctacaatgcgcttatctttaacaagctgaagatggcgctcggaggtcgtgttcgtttcattcttaccggatctgcacccctggaccccacagtgcacaactttttgcgcgtgtgcgtgtgtcccgtcattttgcaagggtatggactaacagagacctgtgctggtgctgccatctccttgacaacagatgttgagctcggccatgtaggtccccctctgaatgtgttcgagacgaagctcgtgagtatccccgatatgaactatctcactactgacgagcagcctcgtggtgaggtgtgcatccgtggagcaggtatcttccagggctacttcaagatgcccgagaagaccaaggaagacattgacgaggagggttggttccacaccggtgatgttggtcgctggaacgattctggaagtctgtcaatcatcgaccgtaagaagtccattttcaagctggcacaaggtgagtatctggctgccgagtatctcgagcagcagtacggcaagtgtgagcacgccggacaggtgtttgtgtatggcgatcccttccgtacctaccctctggcagtgattgttcctgaggaggaggtggttatgctatgggcgaaggcaaacaaggtcagtggaagcttcaaggagatttgtaaaacgccagagctaaaggctctactgaaggcggaggttgtcgatgtgcacaagacatacaagctcaagggatacgaactggtcaaggacttcatcgtcgagtccgaggtttttactgtggataacgagttgcttactcccacgttcaaattgaagcgtcctaacgctaccaagaaataccaagcggcactcactgagatgtacgacaaggtcgatgccgaacttgccgcccgccaagccaagaaatga

SEQ ID NO: 84 - protein, 684 aa, Sphaeroforma arctica
  MISC_FEATURE: fatty acyl CoA synthetase
MGNFLSSEAPAGEASGYLYPDPSDPKLKAQSVIAPGGNWGADAHRCPKYVDGKAEWTDLITSGTPGRETCYANFQATAKEQGDKPWLGTRKVLSDGKPGPYEFITYGEGAKLAEQIGSGLMKLGVAPKSPFGVYSKNRTEWLLAEQGANCYSIPTVAIYDTLGADSVHYVMEHSEMVGAFFESKQLSVVLGAIKKGLPNFKVAISFDEVTEEDKEDYKDVGVDLYPITELYALGKDNIVPHQPPGPDDLHILMYTSGTTGAPKGVMITHRSIVSLLVGLANVMALTSNDVHFSFLPLAHIFERLTQTYCVRWACSVGFFRGVIPELMADVQALRPTYFVAVPRVLTRIYDKIIQGVKAAGGVKEILFNKAFAARDAALKNGEDTPIYNALIFNKLKMALGGRVRFILTGSAPLDPTVHNFLRVCVCPVILQGYGLTETCAGAAISLTTDVELGHVGPPLNVFETKLVSIPDMNYLTTDEQPRGEVCIRGAGIFQGYFKMPEKTKEDIDEEGWFHTGDVGRWNDSGSLSIIDRKKSIFKLAQGEYLAAEYLEQQYGKCEHAGQVFVYGDPFRTYPLAVIVPEEEVVMLWAKANKVSGSFKEICKTPELKALLKAEVVDVHKTYKLKGYELVKDFIVESEVFTVDNELLTPTFKLKRPNATKKYQAALTEMYDKVDAELAARQAKK

SEQ ID NO: 85 - protein, 485 aa, Artificial Sequence
  delta-4 desaturase long preferred consensus sequence
MPPHAATKVGGDSDPELRDLKMEHFSYERILNDERDDLCIVGDGVYDATAFRDKHPGGADFVDLFGGRDATPHFFEYHRREWPPAVLAKYKVGSLDRDDSYVQHDSGYLRLCAEVNGILPKGSGGWAPPSWWIKACALLVAALYLDYYMLARGPTILLAIILGLLFAWIGLNIQHDANHGALSRNPVVNYLFGYAQDWIGGSMMLWLQQHVVGHHLHTNDIDHDPDVKGGGALRLKPTDGWLPWHHLQQLYFLPLEALYGFKWVFLDLHELLEWKWEGEPIPPLARPEFAPAVGCKLGFWARFVALPLWLHPSWHTLLCVCAWVCTGSFYLAFFFILSHIFIGVKSIGPDGKSLPRNIDWARRQIETSSNVGGEWLGHLNGGLNFQIEHHLFPRLHHAHYAKIQPVVQKVCEENGVNYKHFPTIGSNLGSMLSHLGALGARPTWNAEFMAGLEEKSSVECRLRLGAACARGCWCSDAASLISWLG

SEQ ID NO: 86 - protein, 437 aa, Artificial Sequence
  delta-4 desaturase short preferred consensus sequence
MPPHAATKGGDPELRDMEHFSYERILNDERDDLCIVGDGVYDATAFRDKHPGGDFVDLFGGRDATPHFFEYHRREWPPAVLAKYKVGSLDRDDSYVQHDSGYLRLCAEVNGILPKGSGWAPPSWWIKACALLVAALYLDYYMLARGPTILLAIILGLLFAWIGLNIQHDANHGALSRNPVVNYLFGYAQDWIGGSMMLWLQQHVVGHHLHTNDIDHDPDVKGGGALRLKPTDGWLPWHHLQQLYFLPLEALYGFKWVFLDLHELLEWKWEGEPIPPLARPEFAPAVGCKLGFWARFVALPLWLHPSWHTLLCVCAWVCTGSFYLAFFFILSHIFIGVKSIGPDGNIDWARRQIETSSNVGGEWLGHLNGGLNFQIEHHLFPRLHHAHYAKIQPVVQKVCEENGVNYKHFPTIGSNLGSMLSHLGALGARPTEFMAGL

SEQ ID NO: 87 - protein, 439 aa, Artificial Sequence
  delta-4 desaturase 92.6% sequence identity to SEQ ID NO 79
MPPHSRTKVGDPELSDLMKHFTREEILNHTNDDYCILEDGVYDLVNFRDKHPGGDVVDFFPGQDATPHFYMYHQYESPPSVLAEYKVGSIARDDSYVYHTPLMKQICSEVRKVMPMQEGWAPPSWYIKACAILAATLYTDYLWIASGPTIPLAIVSGLLYAAIGLNIQHDANHGSVSRNPMVNRLFGYSQDWIGGSRMLWIQQHVVGHHTHCNRIQHDPDVKGGSVIRLSRYSLPKPFHHIQQYYFLPLEQLLGFQWVFLGAHDLIEMRYKGEKLPESYRKERNIAIGLRVFFFVRKFAVPLALHFSWYTLLCTYLWMCIAALYLGFFFILSHIFVGAKSLPEDANIDWARHQIESSSNVCGEKLGISNGGLNFQIEHHLFPRMSHAHYSKIQPVVQKVCEENGVNYKKFGTIGSNLGSLFRQLKALGSVAIYEFMEGL

SEQ ID NO: 88 - protein, 438 aa, Artificial Sequence
  delta-4 desaturase 91.9% sequence identity to SEQ ID NO 79
MPPHSRTKGSDPELSDMKHFTREEILNHTRDKYCILEDGVYDLTNFRDKHPGGDFLDLFPGQDATPHFYMLHQKESPPSVLAEYKVGSLARDDSYTHHTALMKQIKSAVRKVMPMQEWWAPPSWYIKACAILAATLYTDYLWIASGPTIFLAIVSGLLYAAIGLNIQHDANHGSVSRNPVVNRLFGYSQDWIGGSRMLWIRQHVVGHHTHCNRHQHDPDVKGGSVITLSRYSLPKPWHHIQQYYFLPLIQLLGFQWVFLGLHDLIEMKYKGEKIPESYRKERNIAIGCRVFFFVRKFAVPFALHPSWYTLLCTYLWMAIGAFYLGFFFILSHNFVGIKSLPEDANIEWARHQIESSSNVCGEKLGISNGGLNYQIEHHLFPRMSHAHYSKIQPVVQKVCEENGVNYKHFGTILSNLDSTFRQVGALGAVAIYEFMAGL

SEQ ID NO: 89 - protein, 437 aa, Artificial Sequence
  delta-4 desaturase 91.7% sequence identity to SEQ ID NO 79
MPPHSRTKVSDPELSDMKHFTREEILDHTNDKYCILEDGVYDLTNFRDKHPGGDVLDFFPGQDATPHFYELHRYESLPSVLAEYKVGSVARDDSYVYATPLMKQIKSAVRKVIPMQEWWAPPSWWIKACALLAAALYTDYLWIASGPTIPLAIVIGLLYAAIGLNIQHDANHGSISRNPMVNRLFGYSQDWIGGSRMLWIRQHVVGHHTHCNRHDHDPDVKGGSVITLSPYSLPKEFHHIQQLYFLPLEQLLGFQWVFLGLHDLIEWKYKGEKLPELYRKERNIAIGCRIFFFARKFVIPFALHFSWYTLLCVYLWMATASLYLGFFFILSHIFIGAKSLPEDANIDWARHQIESSSNVGGEKLGILNGGLNYQIEHHLFPRMSHAHYSKIQPVVQKVCEENGVNYKKFGTILSNLDSMFRHVKALGSVAVEFMAGL

SEQ ID NO: 90 - protein, 439 aa, Artificial Sequence
  delta-4 desaturase 91.7% sequence identity to SEQ ID NO 79
MPPHSRTKVSDAELSDMKHFTRERILNHTNDKICILGDGVYDLSNFRDKHPGGDVLDFFPGQDATPHFYMFHKYASLPSVLAEYKVGSLARDDSYVQHTELMKQIKSAVRAVMPMQEWWAPPSWYIKACAILAATLYLDYLWIARGPTIFLGIVSGLLYAAIGLNIQHDANHGSVSRNPMVNRLFGYSQDWIGGSRMLWIRQHVVGHHTHTNDHQHDPDVKGGGVIKLSPVSLPLEFHHIQQYYFLPLDQLLGFQWVFLGLHDLIEMKWKGEKLPELYRKEYNIAIGLRVFFFIRKFVVPFALHFSWYTLICTYLWMATAALYLAFFFILSHIFVGAKSLPEDAKNIDWARHQIESSSNVCGEKLGISNGGLNYQIEHHLFPRMSHAHYSKIQPVVQKVCEENGVNYKKFGTILSNLDSTFRQVKALGSVPVYEFMEGL

SEQ ID NO: 91 - protein, 438 aa, Artificial Sequence
  delta-4 desaturase 91.7% sequence identity to SEQ ID NO 79
MPPSSRSKVSDPELSDMKHFTRERILNHTNDKYCIVEDGVYDLPNFRDKHPGGDVLDFFGGQDATPHFFMFHQYESLPSVLAEYKVGSLARDDSYVYHTELMKQIKSAVRKVIPMQEWWAPPSWYIKACAILAATLYTDYLWIAKGPTIPLAIVLGLLYAAIGLNIQHDANHGSVSRNPMVNRLFGYSQDWIGGSRVLWIRQHVVGHHTHCNRIQHDPDVKGGSVITLSRYSLPMEFHHIQQYYFLPLDQLLGFQWVFLGLHELIEMKWKGEKLPESYRKERNIAVGCRVFFFARKFVVPFALEFSWYTLLCTYLWMAIAAFYLGFFFILSHIFVGAKSLGEDAKNIDWARHQIESSSNVCGEWLGILNGGLNYQIEHHLFPRMNHAHYSKIEPVVQKVCEENGVNYKKFGTILSNLDSMFRQVKALGSVAVEFMEGL

SEQ ID NO: 92 - protein, 439 aa, Artificial Sequence
  delta-4 desaturase 91.7% sequence identity to SEQ ID NO 79
MPPYSRTEVVSDPELKDMEHFSREEILNHTNDKYCILGDGVYDLTNFRDKHPGGEFLSFFPGQDATPHFWMLHQRESLPGVLAEYKVGSVARDDSYVYHDPLMKRICSAVRGVMPMQEWWAPPSWYIKACAILAATLYTDYLWIASGPTIPLAIVSGLLYAAIGLNIQHDANHGSLSRNPMVNRLFGYSQDWIGGSRMLWLRQHVVGHHTHCNRHQHDPDVKGGSVITLSPYSLPKEFHHIQQLYFLPLIQLLGFQWVFLGLHDLIEMKYKGEKLPEIYRKERNPAIGLRLFFFIRKFVVPLALHFSWYTLLCTYLWMAIAALYLGFFFILSHIFVGIKSLPEDANIDWARHQIESSSNVCGEKLGIMNGGLNYQIEHHLFPRMSHAHYSKIQPVVQKVCEENGVNYKHFGTILSNLDSTFRQVKALGSVPTYEFLGGL

SEQ ID NO: 93 - protein, 441 aa, Artificial Sequence
  delta-4 desaturase 91.7% sequence identity to SEQ ID NO 79
MPPHSRTKVSDDPELSDLMKHFAREEILNDNNDDYCILEDGVYDLTNFRDKHPGGDVLDFFPGQDATPHFYMFHQYESLPSVLAKYKVGSVARDDSYVYHTPLMLQIKSEVRAVLPMQEWWAPPSWYIKACAILAATLYTDYLWIASGPTIFLAIVSGLLYAAIGLNIQHDANHGSVSRNPMVNRLFGYSQDWIGGSRMLWIRQHVVGHHTHCNDHQHDPDVKGGSAITLSPTSLPKEFHHIQQYYFLPLDQLYGFQWVFLGLHDLIEMKYEGEKLPEIYRKERNIAIGLRVFFFVRKFAIPFALHFSWYTLLCTYLWMAIAALYLGFFFILSHIFVGVKSLGEDGKNIDWARHQIESSSNVCGEKLGISNGGLNYQIEHHLFPRMNHAHYSTIQPIVQRVCEENGVNYKKFGTILSNLDSTFSQIKALGSVAVYEFMEKI

SEQ ID NO: 94 - protein, 437 aa, Artificial Sequence
  delta-4 desaturase 91.5% sequence identity to SEQ ID NO 79
MPPHSRTKVSDPELSDMKHFARERIANHTNDKYCILEDGVYDLTNFRDKHPGGDVLDIFPGQDATPHFYMYHQKEWPPSVLAEYKVGSVARDDSYVYHTPLQKQLKSAVRKVMPKGSWWAPPSWYIKACAILAATLYLDYLWILSGPTIPLAIVIGLLYAAIGLNIQHDANHGSVSRNPMVNRLFGYGQDWIGGSRMLWIRQHVVGHHTHCNRVQHDPDIKGGSVITLSRYSLPLEFHHIQQYYFLPLEQLLGFQWVFLGAHDLIEMKYKGEKLPESYRKEYNIAIGLRVFFWIRKFVVPFALHFSWYTLLCTYLWMATAALYLGFFFILSHIFIGAKSLPEDANIDWARHQIESSSNVCGDKLGISNGGLNYQIEHHLFPRMSHAHYSKIQPVVQKVCEEMGVNYKKFGTIGSNLDSTFRYVKALGSVAVEFMEGL

SEQ ID NO: 95 - protein, 438 aa, Artificial Sequence
  delta-4 desaturase 91.5% sequence identity to SEQ ID NO 79
MPPHSRTKVSDPELSDMKHFTREKILNHTNDKYCILGDGVYDCTNFRDKHPGGDFLDFFGGQDATPHFYQLHQYESLPSVLAKYKVGSVARDDSYVHHTELMKQIKSAVRAVMPMGEWWAPPSWYIKACAILAATLYTDYLWIASGPTIPLAIVIGLLYAAIGLNIQHDANHGAVSRNPMVNRLFGYSQDWIGGSRMLWIRQHVVGHHLHCNRIQHDPDVKGGSVITLSRYSLPMEFHHIQQYYFLPLIQLYGFQWVFLGLNDLIEMKYKGEKLPESYRKERNIAIGCRVFFFIRKFAVPFALHFSWYTLLCTCLWMAIAALYLGFFFILSHIFVGAKSLPEDANIDWARHQIESSSNVGGEWLGISNGGLNYQIEHHLFPRMSHAHYSKIQPIVQKVCEENGVNYKHFPTILSNLGSTFRYIGALGSVPVYEFMEGL

SEQ ID NO: 96 - protein, 437 aa, Artificial Sequence
  delta-4 desaturase 91.5% sequence identity to SEQ ID NO 79
MPPHSRTKVSDPELSDMKHFTYEEILNHTNDKYCILEDGVYDLTNFRDKHPGGDVLDFFPGQDATPHFYQLHQREWPPSIMAEYKVGSVDRDDSYVYHTSLMKQICCAVRKVMPRQSWWAPPSWYIKACALLAATLYLDYLWIASGPTILLAIVSGLLYAAIGLNIQHDANHGSLSRNPMVNRLFGYSQDWIGGSRMLWIRQHVVGHHTHCNRHQHDPDVKGGSAITLSPYSLPKEFHHIQQYYFLPLIQLYGFQWVFLGLHDLIEMKYKGEPLSEIYRKERNPAIGLRIFFFIRKFVVPFALHFSWYTLLCTYLWMAIAALYLGFFFILSHIFVGAKSLPEDANIDWARHQIESSSNVCGEKLGIMNGGLNYQIEHHLFPRMSHAHYSKIQPVVQKICEDNGVNYKKFGTILSNLDSTFRYVKALGSVAVEFMEKL

SEQ ID NO: 97 - protein, 437 aa, Artificial Sequence
  delta-4 desaturase 91.2% sequence identity to SEQ ID NO 79
MPPHSRTKGSDPELSDMKHFTREEKLNHTRDKICILGDGVYDLVCFRDEHPGGDVVDFFPGQDATPHFYMLHQYEWLPSVLAEYKVGSVARDDSYVYHTPLMKQIKSAVRAVMPMQEGWAPPSWYIKACALLVATLYTDYLWIASGPTIPLAIVSGLLYAAIGLNIQHDANHGSVSRNPVVNRLFGYSQDWIGGSRMLWIRQHVVGHHTHCNDHQHDPDIKGGSVITLKRYDLWLPFHHIQQYYFLPGIQLLGFQWVFLGLHDLIEMKYKGEKLPPSYRKLRNIAIGLRVFFFIRKFVVPFALHFSWYTLLCIYLWMAIAALYLAFFFILSHIFVGVKSLPEDANIDWARHQIESSSNVCGEKLGISNGGLNYQIEHHLFPRMSHAHYSKIQPVVQKVCEENGINYKKFGTIASNLDSTFRQVKALGSVPVEFMEGL

SEQ ID NO: 98 - protein, 437 aa, Artificial Sequence
  delta-4 desaturase 91.2% sequence identity to SEQ ID NO 79
MPPHARTKVSDPELSDMKHFTREEILNHTNDDYCILGDGVYDSTNFRDKHPGGDVLDFFPGQDATPHFYMLHQYESLPSVLARYKVGSVARDDSFTYHTPLMKQIKSEVRKILPMGEWWAPPSWYIKACALLAATLYLDYLWLASGPTIPLAIVSGLLYAAIGLNIQHDANHGSLSRNPVVNRLFGYSQDWIGGSRVLWIQQHVVGHHTHCNRHQHDPDVKGGSVITLSRYSLPKEFHHIQQYYFLPLEQLLGFQWVFLGLNDLIEWKYKGEKLPESYRKDRAIAIGLRVFFFIRKFVIPFALHFSWYTLLCVYLWMAIAALYLCFFFILSHIFVGAGSLPEDANIDWARHQIESSSNVCGEKLGILNGGLNYQIEHHLFPRMSHAHYSKIAPVVQKVCEENGVNYKKFGTILSNLDATFRQVKALGSVAVEFMEKL

SEQ ID NO: 99 - protein, 439 aa, Artificial Sequence
  delta-4 desaturase 91% sequence identity to SEQ ID NO 79
MPPHSATKGSDVPELSDAKHFAREEILNHTRDKYCILGDGVYDSTAFRDKHPGGDYLDFFPGQDATPHFYQFHQYASLPSVLAEYKVGSVARDDSYVQHTELMKQICSAVRKVMPMQEWWAPPSWYIKACALLAATLYTDYLWIASGPTIPLAIVSGLLYAWIGLNIQHDANHGSVSRNPMVNRLFGYSQDWIGGSRMLWIRKHVVGHHTHCNRVQHDPDVKGGSVITLSRYSLPLEWHHIQQIYFLPLIQLYGFQWVFLGLHDLLEMKYKGEKLPPIYRKERNIAIGCRVFFFIRKFVVPFALHFTWYTLLCTYLWMAIAALYLGFFFILSHIFVGAKSLPPDANIDWARHQIESSSNVCGEKLGIINGGLNYQIEHHLFPRMSHSHYSKIQPVVQKVCEENGVNYKKFGTILSNLDSTFKQVKALGSVAVYEFMEGL

SEQ ID NO: 100 - protein, 439 aa, Artificial Sequence
  delta-4 desaturase 91% sequence identity to SEQ ID NO 79
MPPHSRTEVSDPELSDLMKHFTREEILNHNNDKYCILEDGVYDLTCFRDKHPGGDVLDFFPGQDATPGFYMLHQYASPPSVLAEYKVGSVERDDSYVQHTSGMKQIKSAVRAVMPMQEWWAPPSWWIKACAILAATLYTDYLWIASGPTIPLAIVIGLLYAAIGLNIQHDANHGSISRNPMVNRLFGYSQDWIGGSRMLWIRQHVVGHHTHCNRHQHDPDIKGGSVITLSPYSLPKEFHHIQQYYFLPLDQLYGFQWVFLGLHDLIDWKYKGEKLPESYRPDFNIAIGLRVFFFARFFAVPFALHFSWYTLLCTYLWVAIAALYLGFFFILSHIFIGIKSLPEDAKNIDWARHQIESSSNVCGEKLGHSNGGLNYQIEHHLFPRMSHAHYSKIQPVVQKVCEENGVNYKKFPTILSNLDSLFRQVKGLGSVATEFMEGL

SEQ ID NO: 101 - protein, 439 aa, Artificial Sequence
  delta-4 desaturase 91% sequence identity to SEQ ID NO 79
MPPHSRTKGSDPELSDLMKHFTREEILGHTNPDYCILGDGVYDLTNFRDEHPGGDVLDFFPGQDATPHFFQFHQREWLPSVLAEYFVGSVARDDSYVQHTSLMKQIKSAVRKVMPMGEWWAPPSWYIKACAILVATLYTDYLMIASGPTIPLAIVIGLLYAAIGLNIQHDANHGSVSRNPMVNRLFGYSQDWIGGSRMLWIRQHVVGHHTHCNRIQHDPDVKGGSVLTLSRYSLPKEFHHIQQYYFLPLIQLLGFQWVFLGLHDLIEMKYKGEKLPESYRKEYNIAIGLRVFFFARKVVVPFALHFSWYTLLCIYAWMASASLYLGFFFILSHLFVGAKSLPEDANIDWARHQIESSSNVGGEKLGHSNGGLNYQIEHHLFPRMSHAHYSKIQPVVQKICEENGVNYKHFGTILSNLDSTFRQVKALGSVAVYEFMEKP

SEQ ID NO: 102 - protein, 438 aa, Artificial Sequence
  delta-4 desaturase 91% sequence identity to SEQ ID NO 79
MPPHSRRKVSDPELSDLMKHFTRERILNHTRDKYCILEDGVYDLTNFRDKHPGGDVLDFFPGQDATPHFYQYHQHESLPSVLARYKVGSVERDDSYVYHDPLMLQIKSAVRKVIPMQEWWAPPSWYIKACAILIATLFTDYLWIASGPTIPLAIVSGLLYAWIGLNIQHDANHGSVSRNPMVNRLFGYSQDWIGGNRMLWIRQHVVGHHTHCNRVQHDPDVKGGSVITLSPYSLWKEFHHLQQYYFLPLEQLLGFQWIFLGLHDLIEMKWKGEKLPESYRKERNIAIGLRVFFFIRKFVVPFALQFSWYTLLCTYLWMATAALYLGFFFILSHLFIGVKSIPEDANIDWARHQIESSSNVCGEKLGIMNGGLNYQIEHHLFPRMSHAHYSKIQPVVQKVCEEDGVNYKKFGTILSNLGSTFKQVGALGSVAVEFMEGL

SEQ ID NO: 103 - protein, 438 aa, Artificial Sequence
  delta-4 desaturase 91% sequence identity to SEQ ID NO 79
MPPHSRTKVSDPELSAMKHFTREEILNHTNDKYCILEDGVYDLTNFRDKHPGGDVLDFFPGQDATPHFYMLHQKESLPAVLAEYKVGSVARDDSYVYHDALHKQIKSAVRKVMPMQEWWAPPSWYIKACAIIVATLYTDYLMIASGPTILLAIVSGLLFAWIGLNIQHDANHGSVSRNPMVNRLFGYSQDWIGGSRMLWIRQHVVGHHTHCNRHQHDPDVKGGSVITLSRYSLPKEFHHLQQLYFLPLEQLLGFQWVFLGLHDLIEWKYKGEKLSESYRKERGIAIGLKVGFWIRFFVVPFALHFTWYTLLCTYLWVCIAALYLGFFFILSHIFVGVKSLGEDANIDWARHQIESSSNVCGEKLGIINGGLNYQIEHHLFPRMSHAHYSKIQPVVQKVCEENGVNYKHFGTILSNLDSTFKQVGGLGSVPVYEFMEGL

SEQ ID NO: 104 - protein, 440 aa, Artificial Sequence
  delta-4 desaturase 91% sequence identity to SEQ ID NO 79
MPPHSRTKVSDDPELSDLMKHFTYEEILNDTRDKYCILGDGVYDSTNFRDKHPGGDVLDFFPGQDATPHFYMYHQREWLPSVLSEFKVGSLARDDSYVYHTPLMKQIKSAVRKVMPMQEWWAPPSWYIKACAILVATLYTDYLWIARGPTIPLAIVSGLLYAAIGLNIQHDANHGGVSRNPVVNRLFGYSQDWIGGSRMLWIRQHVVGHHTHTNRHQHDPDVKGGSVITLSPTSLPMEFHHIQQIYFLPLEALLGFQWVFLDLHDLLEMKYKGEKLPESYRKERNIAIGLRVFFFIRKVVLPFALHFSWYTLLCTCLWMAIAAFYLGFFFILSHNFVGAKSLPEDANVDWARHQIESSSNVGGEKLGISNGGLNYQIEHHLFPRMSHAHYSKIQPVVQKVCEENGVKYKKFGTILSNLDSTFRHVGALGSVAVYEFMEKL

SEQ ID NO: 105 - protein, 439 aa, Artificial Sequence
  delta-4 desaturase 91% sequence identity to SEQ ID NO 79
MPPHARRKVSDPELSAAKHFTRERILNHTRDKYCILEDGVYDLTNFRDEHPGGDVLDIFPGQDATPHFYMLHRYESPPSVLAEYKVGSVARDDSFTYHTPLMKRIKSAVRAVMPMQEWWAPPSWYIKACAILVATLYLDYLWIAKGPTIPLAIVIGLLFAAIGLNIQHDANHGSVSRNPMVNRLFGYSQDWIGGSMMLWIQQHVVGHHTHCNRHQHDPDVKGGSVITLSRYSGPKEFHHIQQIYFLPLIQLLGFQWVFLGLHDLIEMKYKGEKLPPSYRKERNIAIGCRVFFFIRKFVVPFALHFSWYTLLCTCLWMAIAALYLAFFFILSHIFVGAKSLPEDAKNIEWARHQIESSSNVCGEKLGHSNGGLNYQIEHHLFPRLSHSHYSKIQPVVQKVCEENGVNYKKFPTIGSNLDSTFRHVKALGSVAVYEFMEGL

SEQ ID NO: 106 - protein, 438 aa, Artificial Sequence
  delta-4 desaturase 90.8% sequence identity to SEQ ID NO 79
MPPHSRTKVSAPELSDMKHFTREEIANHTNDKLCILEDGVYDLTNFRDKHPGGDFLDFFPGQDATPHFYMLHQREWLPSVLAEYKVGSVARDDSYVQHDPLMKRIKSAVRKVIPMQEWWAPPSWYIKACAILIATLYTDYLWIASGPTIPLAIVSGLLFAAIGLNIQHDANHGSVSRNPMVNYLFGYGQDWIGGSRMLWIRQHVVGHHTHCNRVQHDPDVKGGSVIRLSRYSLPMEFHHIQQYYFLPLEQLLGFQWVFLGLHDLIEMKYKGEKLPESYRKEFNIAIGLRVGFFARKFVVPFALHPSWYTLLCTCLWMAIAAFYLAFFFILSHIFVGAKSLPPDANIDWARHQIETSSNVCGDWLGHSNGGLNYQIEHHLFPRMSHAHYSKIQPIVQKVCEENGVNYKHFGTILSNLDSIFRQVKALGSVATYEFMEGL

SEQ ID NO: 107 - protein, 438 aa, Artificial Sequence
  delta-4 desaturase 90.8% sequence identity to SEQ ID NO 79
MPPHSRTKVSDPELSALMKHFTREEILGDNNDKYCILEDGVYDLTNFRDKHPGGEVLDFFPGQDATPGFYMLHQYASLPAVLAEYGVGSVARDDSYVHHTPLMKQICSDVRKVMPMGEGWAPPSWYIKACAILAATLYTDYLWIARGPTIPLAIVIGLLFAAIGLNIQHDANHGSVSRNPMVNRLFGYSQDWIGGSRMLWIRQHVVGHHLHCNRHQHDPDVKGGSVITLSRYSLWLEFHHIQQYYFLPLIQLLGFQWVFLGLHDLIEWKYKGEKLPESARPERNIAIGLRVFFFARKIIVPFALHFSWYTLLCTCLWMATAALYLGFFFILSHIFVGAKSLPEDANIDWARHQIESSSNVGGEKLGILNGGLNYQIEHHLFPRMSHAHYSKIQPVVQKVCEENGVNYKHFGTIASNLDSTFSQVGALGSVAVEFMEGL

SEQ ID NO: 108 - protein, 438 aa, Artificial Sequence
  delta-4 desaturase 90.8% sequence identity to SEQ ID NO 79
MPPHSRSKVSDPELKDLMKHFTREEKLNHTNDKYCILEDGVYDLTNFRDKHPGGDVLDLFPGQDATPGFYMLHRYEWLPSVLAEYKVGSVARDDSYVYHTPGYKQIKSAVNKVMPMQEWWAPPSWYIKACAILAATLYTDYLWIARGPTIPLAIVLGLLYAAIGLNIQHDANHGSVSRNPMVNRLFGYSQDWIGGSRMLWLRQHVVGHHTHCNDIQHDPDVKGGGAITLSRVSIPKEFHHIQQYYFLPLDQLLGFQWVFLGLHDLIEWKWKGEKLPPSYRKERNPAIGCRVFFFIRKFVVPLALHFSWYTLLCTYLWVATGALYLGFFFILSHIFVGAGSLPEDANIDWGRHQIESSSNVCGEKLGISNGGLNYQIEHHLFPRMSHAHYSKIQPVVQKICEENGVNYKKFGTILSNLDSTFSQVKALGSVPVEFMEGL

SEQ ID NO: 109 - protein, 438 aa, Artificial Sequence
  delta-4 desaturase 90.8% sequence identity to SEQ ID NO 79
MPPHSRTKVSVPELSDLAKHFTREEILNHTNDKYCILEDGVYDLTNFRDKHPGGDVLDFFPGQDATPHFYMLHRYEWPPSVLAEYKVGSVARDDSYVYHTPLMKQIKSAVRKVIPMGEGWAPPSWYIKACAILAATLYTDYYWIAKGPTIPLAIVSGLLYAAIGLNIQHDANHGSISRNPMVNYLFGYSQDWIGGSRMLWIQQHVVGHHTHCNEIDHDPDVKGGSVITLKRSSLPKEWHHIQQYYFLPLEQLLGFQWVFLGLHDLIEWKYKGEKLPEIYRKERNIAIGCRVFFFARKFAVPFALHFSWYTLLCTYLWMAIGALYLGFFFILSHIFVGAKSLGPEANIEWARHQIESSSNVCGEKLGILNGGLNYQIEHHLFPRMSHAHYSKIAPVVQRVCEENGVNYKKFGTILSNLDSTFRQVKAIGSVAVEFMEGL

SEQ ID NO: 110 - protein, 440 aa, Artificial Sequence
  delta-4 desaturase 90.8% sequence identity to SEQ ID NO 79
MPPHSRTKVSDPELSDLMKHFTREKILNHTNDKYCILEDGVYDLTNFRDKHPGGDFLDFFPGQDATPHFYMLHQYEWLPSVLAEYKVGSVARDDSYVYHDPLHLQICCAVRKVMPMQEWWAPPSWWIKACAILIATLYTDYLWIASGPTIPLAIISGLLYAAIGLNIQHDANHGSVSRNPMVNYLFGYSQDWIGGSRMLWIRQHVVGHHTHSNRHQHDPDVKGGSVITLSRYSLPMEFHHIQQYYFLPLDALYGFQWVFLGLHDLIEMKWKGEPLPELYRKERNIAIGLKVFFFIRKFVVPFALHFSWYTLLCTCAWMAIAALYLAFFFILSHNFVGIKSLPEDASIDWARHQIESSSNVGGEKLGILNGGLNYQIEHHLFPRMSHAHYSKIEPVVQKVCEENGVNYKKFGTIGSNLGATFRYVKALGSVPTYNEFMEGL

SEQ ID NO: 111 - protein, 440 aa, Artificial Sequence
  delta-4 desaturase 90.8% sequence identity to SEQ ID NO 79
MPPHSRTKGSDDPELSDMKHFTYEEILNHTNPKYCILEDGVYDLNNFRDKHPGGDFLDFFPGQDATPHFYMFHQHVSLPSVLAEYKVGSIARDDSYVYHDPLMKQIKSAVRGVMPMQEWWAPPSWYIKACAILAATLYTDYYWLASGPTIPLGIVSGLLYAAIGLNIQHDANHGSLSRNPMVNRLFGYSQDWIGGNRMLWIRQHVVGHHTHCNRIDHDPDVKGGGVITLSRSSLPKEFHHIQQYYFLPLEQLYGFQWVFLGLHDLLEMKYKGEKLPESARKERNIAIGLRVFFFIRKFVVPFWLHFSWYTLLCTYLWMATAAFYLCFFFILSHIFVGVKSLPEDAKNIDWARHQIESSSNVCGEKLGISNGGLNYQIEHHLFPRMHHAHYSKIAPVVQKVCEEMGVNYKKFGTILSNLDSTFRQIKALGSVAVYEYMEGL

SEQ ID NO: 112 - protein, 440 aa, Artificial Sequence
  delta-4 desaturase 90.8% sequence identity to SEQ ID NO 79
MPPHSRTKVSDDPELSDMKHFSREEILDHTRDKYCILEDGVYDLNNFRDKHPGGDVLDFFPGQDATPGFYMLHQRESLPGVLAEYFVGSIARDDSFVHHEPLMKQICSAVRGVLPMQEWWAPPSWYIKACAILAATLYTDYLWIASGPTIPLSIVIGLLYAAIGLNIQHDANHGSVSRNPMVNRLFGYSQDWIGGSRVLWIQKHVVGHHTHCNRVDHDPDVKGGSVITLSPSSLPKEFHHIQQYYFLPLDQLLGFQWVFLGLHDLIEMRYKGEKLPESYRKEFNIAIGLRVFFFIRKFVVPFALHFSWYTLLCTYLWMAIAALYLGFFFILSHIFVGVKSLPEDAKNIDWARHQIESSSNVCGEWLGHSNGGLNYQIEHHLFPRMNHAHYSKIQPVVQKVCEENGVNYKKFPTIGSNLDSIFRQVKALGAVAVYEFMEGP

SEQ ID NO: 113 - protein, 442 aa, Artificial Sequence
  delta-4 desaturase 90.8% sequence identity to SEQ ID NO 79
MPPHSRRKVSDSDPELRDLMKHFTREEILNHTNDKYCILEDGVYDLTNFRDKHPGGDYLDFFPGQDATPHFYMYHQYVSLPSLLAEYKVGSVARDDSYVYHTPLMKQIKADVRKVMPMGEWWAPPSWYIKACALIVATLHTDYLWIASGPTIPLAIVLGLLYAAIGLNIQHDANHGSVSRNPMVNRLFGYSQDWIGGSRMLWIRQHVVGHHTHCNRHQHDPDVKGGSVIQLSPTSLPLEFHAIQQYYFLPGIQLLGFKWVFLGLHDLIEMKYKGEKLSESYRKDRNIAIGLRVFFWVRFFVVPFALHFSWYTILCIYLWMAIGALYLGFFFILSHIFVGAKSLPPDAKNIDWARHQIESSSNVCGDKLGISNGGLNYQIEHHLFPRLSHAHYAPIQPVVRKVCEENGVNYKKFGTIGSNLDSTFQYVKALGSVAVYEFMEGL

SEQ ID NO: 114 - protein, 437 aa, Artificial Sequence
  delta-4 desaturase 90.6% sequence identity to SEQ ID NO 79
MPPHSRTKVSDPELSDMEHFARERILNHTNDKYCILEDGVYDLTNFRDKHPGGDYLDIFPGQDATPHFYMLHQYEWPPSVLARYKVGSLARDDSYVQHTPLMKQICSAVRKVMPMQEWWAPPSWYIKACAILAATLYTDYYWIASGPTIPLGIVSGLLYAAIGLNIQHDANHGSVSRNPMVNRLFGYSQDWIGGSRLLWIRQHVVGHHTHCNDHQHDPDVKGGSVLTLSRVSLPKEFHHIQQYYFLPLIVLYGFQWVFLDLHDLIEMRYKGEKLPESYRPERNIAIGCRIFFFARKFAVPFALHFSWYTLLCTYLWVAIASLYLGFFFILSHNFVGAKSLPEDANIDWARHQIENSSNVCGEKLGILNGGLNYQIEHHLFPRMHHAHYSKIQPVVQKVCEENGVNYKHFGTILSNLDSIFRQVKALGSVAVEFMEGL

SEQ ID NO: 115 - protein, 438 aa, Artificial Sequence
  delta-4 desaturase 90.6% sequence identity to SEQ ID NO 79
MPPHSRTKVGDPELKDMKHFTYERILNHTRDKYCILEDGVYDSTNFRDKHPGGDVLDFFPGQDATPHFYMLHKYEWPPSILAEYKVGSVARDDSYVQATPLMLQIKSAVRKVMPMQEWWAPPSWYIKACAILAATLYTDYLWIARGPTILLAIVSGLLYAWIGLNIQHDANHGAVSRNPMVNRLFGYSQDWIGGSRMLWIRQHVVGHHTHTNRHQHDPDVKGGSVITLSRYDLPKEFHHIQQYYFLPGEQLLGFQWVFLGLHELIEMKWKGEKLPESYRPERNPAIGLKVGFWIRKVVIPFALHFSWYTLLCTYLWMAIAALYLGFFFILSHIFVGVKSLPEDANIDWARHQIESSSNVCGEKLGIMNGGLNYQIEHHLFPRMSHAHYSKIQPVVQKVCEENGVNYKKFGTILSNLDATFRQIKALGSVAVYEYMEGL

SEQ ID NO: 116 - protein, 440 aa, Artificial Sequence
  delta-4 desaturase 90.6% sequence identity to SEQ ID NO 79
MPPHSRKKVVSDPELSDLMKHFSYERILNHTNDDYCILGDGVYDLTNFRDKHPGGDYLDFFPGQDATPHFWMLHQKESPPSVLAEYKVGSVARDDSYVYYDPLMKQIKSAVRKVMPMQEGWAPPSWYIKACAILAATLYTDYLWLASGPTIPLSIVSGLLYAWIGLNIQHDANHGSLSRNPMVNRLFGYGQDWIGGSRMLWIRQHVVGHHTHSNRHQHDPDLKGGSVIRLSRTSLPLEFHHIQQYYFLPLDQLLGFQWVFLGLNDLIEMRYKGEPLPESYRKERNIAIGLKIFFFVRKFVVPFALHFSWYTLLCTCAWMAIAALYLGFFFILSHIFVGAKSLPEDANIDWARHQIESSSNVCGEKLGHSNGGLNYQIEHHLFPRMSHAHYSKIQPVVQRVCEENGVNYKKFGTILSNLDSTFSQVKALGAVAVYEFMGGL

SEQ ID NO: 117 - protein, 438 aa, Artificial Sequence
  delta-4 desaturase 90.6% sequence identity to SEQ ID NO 79
MPPHSRTKVSDDPELSDAKHFTREEILGHTNDKYCILEDGVYDCTNFRDKHPGGDVLDIFGGQDATPHFYMLHQYESPPSVLAKYKVGSVERDDSYVYHEPLMKQIKSAVRKVIPMQEGWAPPSWWIKACALLAATLYTDYLWIARGPTIPLAIVSGLLYAAIGLNIQHDANHGSVSRNPMVNRLFGYSQDWIGGSMMLWIRQHVVNHHTHCNRIDHDPDVKGGSVITLSRYSLPKEFHAIQQYYFLPLEQLLGFKWIFLGAHDLIEMKYKGEKIPESYRKERNIAIGLRVFFFIRKIVVPFALHPSWYTLLCTYLWMCIAALYLAFFFILSHIFVGAKSLPPDANIDWARHQIENSSNVCGEWLGYLNGGLNYQIEHHLFPRMSHAHYSKIQPVVQKVCEENGVNYKKFGTILSNLDSTFRQVKALGAVPVEFMEGL

SEQ ID NO: 118 - protein, 441 aa, Artificial Sequence
  delta-4 desaturase 90.6% sequence identity to SEQ ID NO 79
MPPHSRRKVSDPELRDLKAKHFTYTEILNHTNDDLCILEDGVYDLTNFRDKHPGGDVIDIFPGQDATPGFYMLHKYESLPSVLAEFKVGSVARDDSYVYHTPLMLQIKSAVRKVLPMGEWWAPPSWYIKACAILAATLYLDYYWIARGPTILLAIVLGLLYAAIGLNIQHDANHGSVSRNPMVNRLFGYAQDWIGGSRMLWIQQHVVGHHTHCNDHQHDPDVKGGSVITLSRYSLPLEFHHIQQYYFLPLEQLLGFQWVFLGAHDLIEMKYEGEKLPESYRKERNIAIGCRVFFFIRKFVVPFALHFSWYTLLCTYAWVAIAAFYLGFFFILSHIFIGAKSLPEDAKNIDWVRHQIESSSNVCGEKLGHSNGGLNYQIEHHLFPRMSHAHYSKIQPVVQKVCEEMGINYKKFGTIGSNLDSTLRQVKALGSVAVYEFMEGL

SEQ ID NO: 119 - protein, 438 aa, Artificial Sequence
  delta-4 desaturase 90.3% sequence identity to SEQ ID NO 79
MPPHSRTEVSDPELKAMKHFTREEILNHTNDDICILEDGVYDLTNFRDKHPGGDYLDFFPGRDATPHFYMLHQYESLPSVLAEYKVGSIARDDSYVYHTPGMKQICAEVRKVMPMGEWWAPPSWYIKACAIIAATLYTDYLWIASGPTIPLAIVSGLLYAAIGLNIQHDANHGSVSRNPMVNRLFGYSQDWIGGSRMLWIRQHVVGHHTHTNRHQHDPDVKGGSVITLSRYSLWKEFHHIQQYYFLPLDQLLGFQWVFLGLHDLIEMKYKGEKIPESARPEYNPAIGLRVFFFIRKFVVPFWLHFSWYTLICTYAWMAIAAFYLGFFFILSHNFVGAKSLPPDANIDWARHQIETSSNVCGEKLGISNGGLNYQIEHHLFPRMHHAHYSKIQPVVQKICEENGVNYKHFGTIGSNLDSTLQQVKALGSVPVYEFMEGL

SEQ ID NO: 120 - protein, 438 aa, Artificial Sequence
  delta-4 desaturase 90.3% sequence identity to SEQ ID NO 79
MPPHSRTKVSDDPELRDMKHFTREEILNHTNDDYCILGDGVYDLTNFRDKHPGGDVLSFFPGQDATPHFYMLHQYESLPSVLAEYKVGSIARDDSYVYAEPLQKQIKSAVRKVLPMGEWWAPPSWYIKACAILAATLFLDYLWIASGPTIPLAIVSGLLYAAIGLNIQHDANHGSVSRNPMVNRLFGYSQDWIGGSRMLWIRQHVVGHHTHCNEHDHDPDVKGGSVIQLSPYDLWMPFHHIQQIYFLPLIVLLGFQWVFLGLHDLIEMKYKGEKLPPSYRKEYNPAIGLRVFFWIRKFVVPFWLHFSWYTLLCTCLWMAIAAFYLGFFFILSHIFVGAKSLPEDASIDWARHQIESSSNVGGEKLGHSNGGLNYQIEHHLFPRMSHAHYSKIQPVVQKVCEENGVNYKKFPTIGSNLDSIFRQVKALASVAVEFMEGL

SEQ ID NO: 121 - protein, 437 aa, Artificial Sequence
  delta-4 desaturase 90.3% sequence identity to SEQ ID NO 79
MPPHSRTKVSDPELKDMKHFTREEILNHTNDKYCILGDGVYDLTNFRDEHPGGDVLDFFPGQDATPHFYQLHRYEWPPSVLSEYKVGSVARDDSYVHHTPLHKQLKSAVRKVLPMGEWWAPPSWYIKACAILIATLYTDYLWIASGPTIFLAIVSGLLFAWIGLNIQHDANHGSVSRNPMVNRLFGYSQDWIGGSRMLWLRQHVVGHHTHCNRHDHDPDVKGGGVIRLSRYSLPMPFHHIQQIYFLPLIQLYGFQWVFLGLHDLIEMKYKGEKIPESYRKLYNIAVGLKVFFFIRKFVVPFALHFSWYTLLCTYLWMAIAALYLGFFFILSHLFVGAKSLPEDANIEWARHQIESSSNVCGEWLGISNGGLNYQIEHHLFPRMSHAHYSKIQPVVQKVCEENGVNYKKFGTILSNLGSTFRQVKALGSVAVEFMEGI

SEQ ID NO: 122 - protein, 440 aa, Artificial Sequence
  delta-4 desaturase 90.3% sequence identity to SEQ ID NO 79
MPPHSRTKVSDPELSDLMKHFSRTRILNHTNDKYCILEDGVYDLTNFRDKHPGGDVLDLFPGQDATPHFYELHQYEWLPAVLAEYGVGSIARDDSYVYHDPLMLRLKCEVNGVMPRGEGWAPPSWYIKACAILAATLYTDYLWIASGPTIPLAIVSGLLYAAIGLNIQHDANHGSVSRNPMVNRLFGYSQDWIGGSRMLWIRQHVVGHHIHSNRHDHDPDVKGGGVIRLSRYSLPKEFHHIQQIYFLPLIQLYGFQWVFLGLHDLIEMKYKGEKLPESYRKERNIAIGLRVFFFIRKFILPFALHFSWYTLLCTCLWVAIAALYLGFFFILSHIFVGAKSLPEDAKNIDWARHQIESSSNVCGEKLGISNGGLNYQIEHHLFPRMHHAHYAKIQPVVQKVCEENGINYKKFGTILSNLGSTFQQVKAIGSVAVYEFMEGP

SEQ ID NO: 123 - protein, 438 aa, Artificial Sequence
  delta-4 desaturase 90.1% sequence identity to SEQ ID NO 79
MPPHSRTKVSAPELSDLMKHFTREKILNHTNDKICILEDGVYDATNFRDKHPGGDYLDFFPGQDATPHFYMYHQYESPPSVLAEFKVGSVARDDSYTYHDPLYKRIKSDVRKVLPMQEWWAPPSWYIKACAILAAALYLDYLMIASGPTIPLAIVSGLLYAAIGLNIQHDANHGSVSRNPMVNRLFGYSQDWIGGSRLLWIRQHVVGHHTHCNRVQHDPDVKGGSVITLSRYSLWKEFHHIQQYYFLPLIQLYGFQWVFLGLHDLIDWKYKGEKLPESCRKERAIAIGLRVGFFARKFVLPLWLHFSWYTLLCTCLWMAVAALYLGFFFILSHIFVGAKSLPEDANIDWARHQIESSSNVGGEKLGISNGGLNYQIEHHLFPRMSHSHYSPIAPVVQKVCEENGVNYKKFGTILSNLDSTFRQIKALGSVAVEFMEGL

SEQ ID NO: 124 - protein, 439 aa, Artificial Sequence
  delta-4 desaturase 90.1% sequence identity to SEQ ID NO 79
MPPHSATKVSVPELSDLAKHFTREEILNHTNDKYCILEDGVYDLTNFRDKHPGGDVIDFFPGQDATPHFWMFHQKESPPSVLSEYKVGSVARDDSYTHHDPLMKQIKSAVRKVIPRQEWWAPPSWWIKACAILAATLHTDYLWIASGPTIPLAIVSGLLYAWIGLNIQHDANHGSVSRNPMVNRLFGYSQDWIGGSRMLWIRQHVVGHHTHCNDHQHDPDVKGGSVITLSPYSLPKEFHAIQQYYFLPLDQLYGFQWVFLGAHDLIEMKYKGEPLPESYRKEYNIAIGLRVFFFIRKFVLPFALHPTWYTLLCIYLWMAIAAFYLGFFFILSHIFVGAKSLPPDAKNIDWARHQIESSSNVCGEWLGISNGGLNYQIEHHLFPRMNHAHYSKIEPVVQKVCEENGVNYKHFGTIGSNLDSTFRQVKALGAVPVEFMEGL

SEQ ID NO: 125 - protein, 438 aa, Artificial Sequence
  delta-4 desaturase 90.1% sequence identity to SEQ ID NO 79
MPPHSRTEVSDDPELSDMKHFTREEILNHTNDKLCILEDGVYDATNFRDKHPGGDFLDFFPGQDATPHFYMYHQYESPPSVLAKYKVGSVDRDDSYVYHTPLMKQIKSAVRKIMPRQEWWAPPSWWIKACAILVATLYTDYLWIASGPTILLGIVSGLLYAAIGLNIQHDANHGSVSRNPVVNRLFGYSQDWIGGSRMLWIRQHVVGHHTHTNDIQHDPDVKGGSVIRLSRYSIWKPFHHIQQYYFLPLDQLYGFQWVFLGLHDLIEMKYKGEKLPESYRPLRNIAIGLRVFFFVRKFVLPFALHFSWYTLLCIYLWMAIAALYLGFFFILSHIFVGAKSLPEDGNIDWVRHQIESSSNVGGEKLGISNGGLNYQIEHHLFPRMSHAHYSKIQPVVQKVCEEDGVKYKKFGTIASNLDSTLSQVKALGSVAVEFMEGL

SEQ ID NO: 126 - protein, 438 aa, Artificial Sequence
  delta-4 desaturase 90.1% sequence identity to SEQ ID NO 79
MPPHSRTKGGDPELSDMKHFTREKILNHTNDKYCIVEDGVYDLTNFRDKHPGGDVLDFFGGQDATPHFFMLHQRESPPSLLAEYKVGSVARDDSYVYHTPLMKQICSAVNGVMPMGEGWAPPSWYIKACAILAATLYLDWLWIASGPTIPLAIVSGLLYAAIGLNIQHDANHGAVSRNPAVNRLFGYSQDWIGGSRMLWIRQHVVGHHTHCNDHQHDPDVKGGSAITLSRTDLPKEFHHIQQYYFLPLEQLLGFQWVFLGLHDLIEMKYKGEPLPESYRKLRNIAVGCRIFFFARKFAVPFALHFSWYTLLCTCLWMAIAALYLGFFFILSHIFVGAKSLPPDANIDWARHQIESSSNVCGEKLGISNGGLNYQIEHHLFPRMSHAHYSKIQPVVRKVCEENGINYKKFGTILSNLDSTFRQLKAIGSVPVYEFMEGL

SEQ ID NO: 127 - protein, 439 aa, Artificial Sequence
  delta-4 desaturase 90.1% sequence identity to SEQ ID NO 79
MPPHSAKKGSDVPELRDLMKHFTRTEILNHTNDKLCILGDGVYDLTNFRDKHPGGDVLDFFPGQDATPHFYMLHQYESLPSVLAEYGVGSVDRDDSYVYHTPLHKQIKSAVRKVMPMQEWWAPPSWYIKACAILAATLYLDYLWIASGPTIPLAIVSGLLYAAIGLNIQHDANHGGVSRNPMVNYLFGYSQDWIGGSRMLWIRQHVVGHHTHCNRHQHDPDVKGGGVITLSPYSLPKEFHHIQQYYFLPLEQLLGFKWVFLGLHDLIEMKYKGEKLPESYRKERNIAVGLRVFFFIRKFVIPFALHFSWHTLLCIYLWMAIGALYLGFFFVLSHIFVGVGSLGEDANVDWARHQIETSSNVCGEKLGIMNGGLNYQIEHHLFPRMSHAHYSPIQPVVQKVCEENGVKYKKFGTILSNLDSTFSQVKALGSVATEFMGKI

SEQ ID NO: 128 - protein, 437 aa, Artificial Sequence
  delta-4 desaturase 89.9% sequence identity to SEQ ID NO 79
MPPHSRTKVGDPELSDMKHFTREEILDHTNDKLCILEDGVYDATAFRDKHPGGDVLDFFPGQDATPHFYMYHQHESPPSVLAEYKVGSLARDDSYVYHTAGMKQIKSAVRGIIPMQEWWAPPSWYIKACAILAATLYTDYLWIASGPTIPLAIVSGLLYAAIGLNIQHDANHGSVSRNPAVNRLFGYSQDWIGGSMMLWIRQHVVGHHTHTNRIDHDPDVKGGSVIQLSPSSLPKPWHHIQQYYFLPLIQLLGFQWVFLGLHDLIEWKYKGEKLPESCRKERNIAIGCRIFFFARKFAVPFWLHFSWYTLLCTYLWMAIAALYLGFFFILSHIFIGAGSLPEDANIDWARHQIESSSNVCGEKLGIINGGLNYQIEHHLFPRMSHAHYSKIQPVVQKVCEENGVNYKHFGTILSNLDSTFRQVKALGSVPVEFMEGP

SEQ ID NO: 129 - protein, 439 aa, Artificial Sequence
  delta-4 desaturase 89.9% sequence identity to SEQ ID NO 79
MPPHSRTKVSDVPELSDLMKHFTREEILNHNNDKICILGDGVYDLTNFRDKHPGGDVLDFFPGQDATPHFYMYHQYESPPSVLAEYKVGSVARDDKYVQHTPLMKQIKADVRKVMPMGEWWAPPSWYIKACAILIATLYTDYLWIARGPTIPLAIVSGLLYAAIGLNIQHDANHGSLSRNPMVNRLFGYAQDWIGGSRMLWIRQHVVGHHLHCNRIDHDPDVKGGSVIKLSPYDGPKEWHHIQQIYFLPLIQLYGFQWVFLGLHDLIEWRYKGEKLPESYRKEFNIAIGLRVFFFIRFFVLPFALHFSWHTLLCTYLWMAIGALYLAFFFILSHIFVGAKSLPPDANIDWARHQIESSSNVCGEWLGISNGGLNYQIEHHLFPRMHHAHYSPIQPVVQRVCEENGVNYKKFGTIASNLDSTFRQVKALGSVAVEFMEGL

SEQ ID NO: 130 - protein, 438 aa, Artificial Sequence
  delta-4 desaturase 89.7% sequence identity to SEQ ID NO 79
MPPHSRTKVSDDAELSDMKHFTREEILDHTNDKYCILEDGVYDCTNFRDKHPGGDVIDFFPGQDATPHFYMLHQKAWPPSVLAEYFVGSVARDDSYVQHEPLHKQICSAVRKVMPMQEWWAPPSWYIKACAILAATLYTDYLWIASGPTIPLSIVSGLLYAAIGLNIQHDANHGSVSRNPMVNYLFGYGQDWIGGSRVLWIRQHVVGHHTHTNDHDHDPDVKGGSVITLSRSSGPKEWHHIQQYYFLPGIQLYGFKWVFLGLHDLIEWKYKGEKLPEIYRKERNIAIGLRVFFFIRKFVVPFALHFSWYTLLCTYAWMATGAFYLGFFFILSHIFIGAKSLPEDANIDWARHQIESSSNVCGEKLGYSNGGLNYQIEHHLFPRMSHAHYSKIQPVVRKVCEDNGVNYKHFGTILSNLGSTFRQVKALGSVAVEFMEGP

SEQ ID NO: 131 - protein, 438 aa, Artificial Sequence
  delta-4 desaturase 89.7% sequence identity to SEQ ID NO 79
MPPHARTKGSDPELKDMKHFTREEILNHNNDKYCILGDGVYDLTNFRDKHPGGDYLDFFGGQDATPHFYEYHQHESPPSVLAEYKVGSVARDDSYVQHTELMKQIKSAVRGVLPMQEWWAPPSWYIKACALIVATLYLDYLWIASGPTIFLAIVSGLLYAAIGLNIQHDANHGSVSRNPVVNRLFGYSQDWIGGSRMLWIQKHVVGHHLHCNRHQHDPDVKGGSVITLSPYSGWKEFHHLQQIYFLPLIQLLGFQWVFLGLHDLIEMKYKGEKLPEIYRKLRNIAIGCRVFFFIRKFVVPFWLHFSWYTLLCTYLWMASAALYLGFFFILSHIFVGAKSLPEDANIDWARRQIESSSNVCGEKLGHSNGGLNYQIEHHLFPRMSHAHYAKIQPVVQKVCEENGVNYKHFGTILSNLDSTFRQVKALGSVAVYEFLEGL

SEQ ID NO: 132 - protein, 438 aa, Artificial Sequence
  delta-4 desaturase 89.7% sequence identity to SEQ ID NO 79
MPPHGRTEGSDPELRDMKHFTRERILDHTNDKLCILEDGVYDLNNFRDKHPGGDFLDFFPGQDATPHFFQLHQYESLPSVLAEYKVGSVARDDSYVYHDPLMKQLKSAVRAVMPKQEGWAPPSWYIKACAILAATLYLDYLWIASGPTIPLAIVSGLLYAAIGLNIQHDANHGSISRNPMVNYLFGYSQDWIGGSRMLWIRQHVVGHHTHCNRHQHDPDVKGGSVITLSPYSLPKEWHHIQQYYFLPLDQLLGFQWVFLGLHDLIDMRYKGEKLPPIYRKERAPAIGLRVFFFIRFFVVPFWLHPSWYTLLCTCAWVAIAAFYLGFFFILSHIFVGIKSLPEDAKNIDWARHQIESSSNVCGDKLGYSNGGLNYQIEHHLFPRMSHAHYSKIQPVVQKVCEENGVNYKKFGTILSNLDSTFRQVKALGSVPVEFMEGL

SEQ ID NO: 133 - protein, 440 aa, Artificial Sequence
  delta-4 desaturase 89.7% sequence identity to SEQ ID NO 79
MPPHSRTKVSDPELRDLMKHFTREEILNHTNDDYCILGDGVYDLTNFRDEHPGGDFLDFFPGQDATPHFYMLHQRESLPSVLAEYKVGSVDRDDSYVQHEPLMKQIKSAVRKIMPKQEWWAPPSWWIKACAILAAALYTDYLWILSGPTIPLAIVSGLLYAWIGLNIQHDANHGSISRNPMVNRLFGYSQDWIGGSRMLWIRQHVVGHHIHCNRHDHDPDLKGGSAIQLSRVSLPKEFHHIQQYYFLPLEQLYGFQWVFLGLHDLIDMKWKGEKLPESYRPEYNIAIGLRVGFFIRKFVVPLALHFSWYTLLCTYLWMAIAALYLCFFFILSHIFVGIKSLPEDAKNIDWARHQIESSSNVGGEKLGHINGGLNYQIEHHLFPRMSHAHYAKIQPVVQKVCEENGVNYKHFGTIASNLDALFRQVKALGSVPVYEFMEGL

SEQ ID NO: 134 - protein, 437 aa, Artificial Sequence
  delta-4 desaturase 89.7% sequence identity to SEQ ID NO 79
MPPHSRTKVGDPELRAMEHFTRERILNHTNDKYCILEDGVYDLTNFRDKHPGGDVIDFFPGRDATPHFYMLHQRESLPSVLAEYFVGSVARDDSYVYYTPLHKQIKSAVRGVMPMQSWWAPPSWYIKACAILAATLHTDYLWIASGPTIPLAIVLGLLYAAIGLNIQHDANHGSVSRNPMVNRLFGYSQDWIGGSRMLWIRQHVVGHHIHTNRHQHDPDVKGGSVIRLSRYSLWKEFHHIQQYYFLPLEQLYGFQWIFLGLHDLIEMKYKGEKLPELYRKEFNIAIGLRVFFFARKFVVPFALHFSWYTLLCTYLWMAIGAFYLCFFFILSHIFVGVKSIPEDANIDWARHQIESSSNVCGEWLGISNGGLNYQIEHHLFPRMSHAHYSKIEPVVQKVCEENGVKYKKFPTILSNLDSTFRQIGALGSVAVEYMEKL

SEQ ID NO: 135 - protein, 438 aa, Artificial Sequence
  delta-4 desaturase 89.7% sequence identity to SEQ ID NO 79
MPPHGRTKVSDDPELSDMKHFTREEILNHTNDKYCILEDGVYDLTNFRDEHPGGDVLDFFPGQDATPHFWMYHRYASPPSVLAEYKVGSVDRDDSYVYHEPLMKQLKADVRKVMPMQEGWAPPSWWIKACAILAATLHLDYLMIAKGPTIPLAIVSGLLYAAIGLNIQHDANHGSVSRNPMVNRLFGYSQDWIGGSRMLWIREHVVGHHTHCNRHQHDPDVKGGSVITLSPYSLPLPFHHIQQYYFLPLEQLYGFQWVFLGLHDLIEMKYKGEPLPESYRKERNIAIGLRVFFFVRKIVVPFALHFSWYTLLCTYLWMASAAFYLAFFFILSHIFVGVKSLGEDANIDWARRQIESSSNVCGEKLGISNGGLNYQIEHHLFPRMSHAHYSKIQPVVQKVCEEDGVNYKKFPTILSNLDATFRHVGALGSVAVEFMEKL

SEQ ID NO: 136 - protein, 438 aa, Artificial Sequence
  delta-4 desaturase 89.7% sequence identity to SEQ ID NO 79
MPPHSRRKVSDPELSDAKHFTYTEKLNHTNPKYCILEDGVYDLSNFRDKHPGGDVLDFFPGQDATPHFYMYHQYESPPSVMAEYKVGSVARDDSYVYATELMLQIKSAVRKVMPMQEWWAPPSWYIKACAIIAATLYTDYLWIASGPTIPLAIVLGLLYAWIGLNIQHDANHGSVSRNPMVNRLFGYSQDWIGGSRMLWIRQHVVGHHTHCNRIQHDPDVKGGGVITLSRTSLPKEFHHIQQLYFLPLIQLYGFQWVFLDLHDLIEMKYKGEPLPPLYRKEFAIAIGLRVGFWIRKFVVPFALHFSWYTLLCIYLWMASAAFYLGFFFILSHIFVGAKSLPEDAKNIDWARHQIESSSNVCGEKLGHSNGGLNYQIEHHLFPRMSHAHYAPIQPVVQKICEENGINYKKFGTILSNLDSTFRQVKALGSRATEFMEGL

SEQ ID NO: 137 - protein, 439 aa, Artificial Sequence
  delta-4 desaturase 89.7% sequence identity to SEQ ID NO 79
MPPHARSEVSDPELSDLMKHFTRERILNHNNDKYCILGDGVYDCVNFRDKHPGGDFVDFFPGQDATPHFFMLHRHESLPSVLAEYKVGSVARDDSYVYHDPLMKQICSAVRKVMPMQSWWAPPSWWIKACAILAATLYTDYLWIASGPTIPLAIVLGLLYAAIGLNIQHDANHGSVSRNPMVNYLFGYSQDWIGGSRMLWIRQHVVGHHTHTNDHDHDPDVKGGSVITLSRYSLPKEFHHIQQIYFLPLIQLYGFQWVFLDAHDLIEMKYKGEKIPESYRKERAIAIGCRVFFFIRKFVLPFALHFSWYTLLCTCLWMAIAALYLGFFFILSHIFVGAKSIGEDANIDWGRRQIESSSNVCGEKLGIINGGLNYQIEHHLFPRMSHAHYSKIQPVVQKVCEENGVNYKKFGTIGSNLDSTFRHLKALGSVAVYEFMEGP

SEQ ID NO: 138 - protein, 439 aa, Artificial Sequence
  delta-4 desaturase 89.7% sequence identity to SEQ ID NO 79
MPPHARTKVGDPELSDLMEHFTREEILGHENDKYCILEDGVYDLNNFRDKHPGGDVLDIFPGQDATPHFWMLHQRVSPPSVLAEYKVGSVARDDSYVYHTPLYKQIKSAVRKVIPMGEWWAPPSWWIKACAILAATLYTDYYWIASGPTIPLAIVIGLLYAAIGLNIQHDANHGSVSRNPMVNRLFGYSQDWIGGSRMLWIRQHVVGHHTHCNRHQHDPDVKGGSVITLSRTSLWMPFHHIQQIYFLPGEQLLGFQWVFLGLHDLIEMKYKGEKLPESARKERNIAIGLRIFFFIRKFVVPFALHFSWHTLLCTYLWMASAALYLGFFFILSHIFVGAGSLPPEAKNIDWGRHQIESSSNVGGEKLGILNGGLNFQIEHHLFPRMSHAHYSKIQPVVQKVCEENGVNYKKFPTILSNLDSTFKQIGALGSVAVEFLEGL

SEQ ID NO: 139 - protein, 438 aa, Artificial Sequence
  delta-4 desaturase 89.7% sequence identity to SEQ ID NO 79
MPPHSRTKVSDPELSALMKHFTREKKLNHTNDDYCILGDGVYDLTAFRDKHPGGDVLDFFPGQDATPHFFMLHQYESLPAVLAEYKVGSIARDDSYVYYTALMKQIKSAVRAVMPMGEWWAPPSWYIKACAILAATLYTDYLWIASGPTILLAIVSGLLFAAIGLNIQHDANHGSVSRNPMVNRLFGYSQDWIGGSRMLWIREHVVNHHLHTNRHQHDPDLKGGSVITLSRTDLPKPFHHIQQYYFLPLEQLYGFQWVFLGLHDLIEWKYKGEPLPESYRKERNIAVGLRVFFFIRFFIIPFWLEFSWYTLLCTYLWMAIAALYLGFFFILSHIFVGAKSLPEDANIDWARRQIESSSNVCGEKLGHSNGGLNFQIEHHLFPRMSHAHYSKIQPVVQKVCEENGVNYKKFGTIGSNLDSTFRHVKALGSVAVEFMEGP

SEQ ID NO: 140 - protein, 438 aa, Artificial Sequence
  delta-4 desaturase 89.4% sequence identity to SEQ ID NO 79
MPPHSRTKVSDPELSDMKHFTREEILNHTRDKYCILEDGVYDATAFRDKHPGGDYIDFFPGQDATPHFYMLHRYESLPSVLAEYKVGSVARDDSYVQHDELMLQLKAAVRAVMPMQEWWAPPSWYIKACAILAATLYLDYLWIASGPTIPLGIVLGLLYAAIGLNIQHDANHGSVSRNPVVNRLFGYSQDWIGGSRMLWLRQHVVGHHLHSNEHQHDPDIKGGSAIRLSPYSLPKEWHHIQQLYFLPGIQLLGFQWVFLGLHDLIEMKYKGEKLPPSYRKERNIAIGCRVFFWIRKFVVPFALHFSWYTLLCTYLWMAIGALYLGFFFVLSHIFVGAKSLPEDAKNVDWARHQIESSSNVCGEKLGISNGGLNYQIEHHLFPRMSHAHYSKIQPVVRKVCEENGINYKHFPTILSNLDSTFRQVKALGSVPTEFMEGL

SEQ ID NO: 141 - protein, 438 aa, Artificial Sequence
  delta-4 desaturase 89.4% sequence identity to SEQ ID NO 79
MPPHSRTKVSDAELSDLMKHFTREEILNDTNDKYCILEDGVYDLTNFRDKHPGGDVLDFFPGQDATPGFWMFHQYAWLPSVLAEYKVGSIARDDSYVQYTPLMLQIKCAVRKVLPMQSWWAPPSWYIKACAILIATLYTDYLWIASGPTIPLAIVIGLLYAAIGLNIQHDANHGSVSRNPMVNRLFGYSQDWIGGSRMLWIREHVVGHHTHCNRIQHDPDIKGGSVITLSPSSLWLEWHHIQQYYFLPLEQLLGFQWIFLGLHDLIEWKYEGEKIPESYRKLRNIAIGCRVFFFIRKFAIPFALHFSWYTLLCTYLWMATAALYLGFFFILSHIFVGAKSLPEDANIDWARRQIESSSNVCGEWLGISNGGLNYQIEHHLFPRMSHAHYSKIQPVVQKVCEENGVNYKKFPTILSNLGSTFQHVKALGSVAVEFMEGL

SEQ ID NO: 142 - protein, 439 aa, Artificial Sequence
  delta-4 desaturase 89.4% sequence identity to SEQ ID NO 79
MPPHSRTKVGSDPELRDLMKHFTREEILNHTRDKYCILEDGVYDLTNFRDKHPGGDVVDFFPGQDATPGFYMLHQYESLPSVLAKYFVGSVARDDSYVYHDPLQKQIKSAVRKIMPRQEWWAPPSWWIKACAILAATLYLDYLWIAKGPTIFLAIISGLLYAAIGLNIQHDANHGSVSRNPMVNRLFGYSQDWIGGSRMLWLRQHVVGHHTHCNRHQHDPDVKGGSVIKLKPTSLWLEFHHIQQYYFLPLDQLLGFQWIFLGLHDLIEMRYKGEKLPPSYRKERNPAIGCRVFFFIRKFVVPFALHFSWYTLLCTYLWVAIGALYLGFFFILSHIFVGAKSLPEDANIDWARHQIESSSNVGGDKLGYSNGGLNYQIEHHLFPRMSHAHYSKIQPVVQRVCEENGINYKKFGTILSNLDSIFQQVKALASVPVEYMEGL

SEQ ID NO: 143 - protein, 440 aa, Artificial Sequence
  delta-4 desaturase 89.4% sequence identity to SEQ ID NO 79
MPPHARTKVSDPELSDAKHFTREEILNHTNDKLCILEDGVYDAPNFRDKHPGGDVLDFFPGQDATPHFYMLHQYEWPPSVLAEYKVGSVARDDSYTQATPLMKQIKSAVRKVMPMGEWWAPPSWYIKACALLAATLHTDYLWIASGPTIPLAIVSGLLYAAIGLNIQHDANHGSVSRNPMVNRLFGYSQDWIGGSMMLWIRQHVVGHHTHSNRHQHDPDVKGGSVIKLSRYSLPLEFHHIQQIYFLPGDQLYGFQWVFLGLHDLIEMKYKGEKISESYRKERNPAIGCKVFFFIRKFVVPFWLHFSWYTLLCVCLWMATAAFYLGFFFILSHNFVGVKSLGPDAKNVDWARHQIESSSNVCGEWLGISNGGLNYQIEHHLFPRMNHAHYSKIQPVVQKVCEENGVNYKKFPTILSNLGSTFRQVKALGSVAVYNEFLAGL

SEQ ID NO: 144 - protein, 438 aa, Artificial Sequence
  delta-4 desaturase 89.4% sequence identity to SEQ ID NO 79
MPPHSATKVSDPELSDMKHFTREKILDHTNDKYCILEDGVYDCPNFRDKHPGGDVLDFFPGQDATPHFFEYHQHEWLPSVLAEYFVGSVDRDDSYVYHTSLMKQIKAAVRGIMPRQEWWAPPSWYIKACAILAATLYTDYLWIASGPTIPLAIVSGLLYAAIGLNIQHDANHGSISRNPMVNRLFGYSQDWIGGSRMLWIRQHVVGHHTHCNRHDHDPDLKGGSVIKLSRYDLPKEFHHIQQYYFLPLIQLLGFQWVFLDLHDLIEWKYKGEKLPESCRPLRNIAIGLRIFFWIRKFVVPFALHFSWYTLLCTCLWMATAALYLCFFFILSHIFVGIKSLPEDAKNIDWARHQIENSSNVCGEKLGISNGGLNYQIEHHLFPRMSHAHYSKIQPVVQKVCEENGVNYKKFGTILSNLDSTFKQLGALGSRATEFMAGL

SEQ ID NO: 145 - protein, 439 aa, Artificial Sequence
  delta-4 desaturase 89.4% sequence identity to SEQ ID NO 79
MPPHSRTKVSDDPELKDLMKHFSYEEILNDTNDKYCILGDGVYDATNFRDKHPGGDVLDIFGGRDATPHFYELHQYESLPSVLAEYKVGSVDRDDSYVYHDPLMLQIKSAVRKVMPMQEWWAPPSWYIKACAILVATLYTDYLMIASGPTIPLAIVLGLLYAAIGLNIQHDANHGSISRNPMVNRLFGYSQDWIGGSRMLWIREHVVGHHTHCNDHQHDPDIKGGSAITLSRYSLPKEWHHIQQYYFLPLIALLGFQWVFLGLHDLIEWKYKGEKIPESYRPERNIAIGLRVFFFIRKFALPFALHFSWHTLICTYLWMAIGAFYLGFFFILSHIFVGIKSLPEDANVDWARHQIESSSNVCGEKLGHSNGGLNYQIEHHLFPRMSHAHYSKIQPVVRKVCEDNGVNYKKFPTILSNLDSMFRQVKALGSRATEFMEGL

SEQ ID NO: 146 - protein, 439 aa, Artificial Sequence
  delta-4 desaturase 89.4% sequence identity to SEQ ID NO 79
MPPHSGTKVSDDPELSDLMKHFTYEEIANHTNDDYCILEDGVYDLVNFRDEHPGGDVLDFFPGQDATPGFYMLHRYESLPAVLAEYKVGSVERDDSYVHHDPLMKQICSEVRKIMPMQEWWAPPSWWIKACAILAATLYTDYLWIASGPTIPLAIVSGLLFAAIGLNIQHDANHGSVSRNPMVNRLFGYSQDWIGGSRVLWIRQHVVGHHTHCNEVQHDPDVKGGGVITLSRTSLPKEFHHIQQYYFLPLDQLLGFQWVFLDLHDLLEMKWKGEKLPESARPERNIAIGLKVFFFIRKVVVPFWLQFSWHTLLCTYLWMATAALYLAFFFILSHIFVGAKSIPPDANIDWARHQIESSSNVCGEKLGISNGGLNYQIEHHLFPRMSHAHYSPIQPVVQKVCEENGVNYKKFPTILSNLDSTFRQIKALGSVATEFMEGL

SEQ ID NO: 147 - protein, 437 aa, Artificial Sequence
  delta-4 desaturase 89.2% sequence identity to SEQ ID NO 79
MPPHSRTKGSAPELSDMKHFSRERILNHTNDDYCILEDGVYDLTNFRDKHPGGDFLDFFPGQDATPHFYMFHQYEWLPSVLAEYGVGSVARDDSYVQHTPLMKQLKSAVRKVMPMQEWWAPPSWYIKACAILAATLYTDYLWIAKGPTIPLAIVSGLLFAAIGLNIQHDANHGSISRNPMVNRLFGYSQDWIGGGRMLWIREHVVGHHTHCNEIQHDPDVKGGSVITLSPYDLWKEFHHIQQYYFLPLIQLYGFKWVFLGLHDLIEMKYKGEKLPESARKERNIAVGLRVFFFIRKVVVPFALHFTWYTILCTYLWMAIAALYLGFFFILSHIFVGAKSLGPDANVDWARHQIESSSNVGGEKLGHSNGGLNFQIEHHLFPRMHHAHYAKIQPVVQKICEENGVNYKKFGTILSNLDSMFSQVKALGAVAVEFMEGL

SEQ ID NO: 148 - protein, 437 aa, Artificial Sequence
  delta-4 desaturase 89.2% sequence identity to SEQ ID NO 79
MPPYSRTKVSVPELSDMKHFTREEILNHTNDKLCIVEDGVYDCTNFRDKHPGGDVLDLFPGQDATPHFYMFHQYEWLPSVLARYKVGSVARDDSYVYHTPLMKQIKSDVRKILPMQEWWAPPSWYIKACAILVAALYLDYLWIASGPTIFLAIVSGLLYAAIGLNIQHDANHGSVSRNPMVNRLFGYSQDWIGGGMMLWIRQHVVGHHTHCNDIQHDPDVKGGSVIKLSRTSIPLEWHHLQQYYFLPLIQLLGFQWVFLDLHDLIEMKYKGEKLPESYRKERNIAIGLRVFFFIRKFVVPFALHFSWYTLLCTYLWMAIAALYLGFFFILSHLFVGAKSLPPDGSIDWARHQIESSSNVGGEKLGISNGGLNYQIEHHLFPRLSHAHYAKIQPVVQKVCEENGVNYKKFPTILSNLGSMFRQVKALGSVPVEFMAKL

SEQ ID NO: 149 - protein, 437 aa, Artificial Sequence
  delta-4 desaturase 89.2% sequence identity to SEQ ID NO 79
MPPHSRTEVGDPELSDMKHFTREEIANHTNDDYCILEDGVYDLTCFRDKHPGGDVLDFFPGQDATPHFFMFHQYESLPSVLAEYGVGSVARDDSYVQHDPLMKQIKSAVRKIMPMGSWWAPPSWWIKACAILAATLYTDYLWIARGPTIPLAIILGLLYAAIGLNIQHDANHGSVSRNPMVNRLFGYSQDWIGGNRMLWIRQHVVGHHTHCNRHDHDPDVKGGSVIRLSRYSLPKPWHHIQQIYFLPLIQLLGFQWVFLGLHDLIEMRYEGEKLPESYRKERGIAVGLRVGFFIRKFVVPFWLHFSWYTLLCTCLWMAIGAFYLGFFFILSHIFVGAKSLPEDGNIDWARHQIESSSNVGGEKLGYSNGGLNFQIEHHLFPRMSHAHYAKIEPVVQKVCEENGVNYKKFPTILSNLDSTFRQVKALGSVPVEFMEGL

SEQ ID NO: 150 - protein, 438 aa, Artificial Sequence
  delta-4 desaturase 89.2% sequence identity to SEQ ID NO 79
MPPHSGTKVSDPELSAMKHFAREEILNHTNDKICILEDGVYDLVNFRDKHPGGDYLDFFPGQDATPHFYMLHRYESPPSVLAEYKVGSVARDDSYVYHTPLMKQIKSAVRKVMPMQEWWAPPSWYIKACAILAATLHTDYLMIASGPTIPLAIVSGLLFAAIGLNIQHDANHGSVSRNPMVNRLFGYAQDWIGGSRMLWIQQHVVGHHTHCNRIDHDPDVKGGSVITLSRTSLPLEFHHIQQLYFLPLIQLYGFQWVFLDLHDLIEMKYKGEKLPELYRPEYGIAIGLRVFFWIRKFIVPFALHFSWYTLLCTYLWMAIGAFYLGFFFILSHIFVGAKSLGEDGNIDWARHQIESSSNVCGEKLGYMNGGLNYQIEHHLFPRLSHAHYSKIQPVVRKVCEENGVNYKKFGTIASNLDSLFRYLGGLGSVPVYEFMEGL

SEQ ID NO: 151 - protein, 437 aa, Artificial Sequence
  delta-4 desaturase 89.2% sequence identity to SEQ ID NO 79
MPPHSRTKVSDPELSDMKHFTREEKLNDTNDDYCILEDGVYDLSNFRDKHPGGDYVDFFGGQDATPHFYMLHQRESPPSVMSKFKVGSVARDDSYVYHTPLMKQIKSAVRKVMPKQEWWAPPSWYIKACAILIATLFTDYLMIASGPTIPLAIVSGLLYAWIGLNIQHDANHGSVSRNPMVNRLFGYSQDWIGGSRMLWIQQHVVGHHTHCNRHQHDPDVKGGSAITLSPYSLWKEWHHIQQYYFLPLIQLLGFQWVFLGLHDLIEMKYKGEPLPPSYRKERNIAIGLRVFFWIRKVVVPFWLQFSWYTLLCTYLWMAIGALYLGFFFILSHIFVGAKSLPEDANIDWARHQIESSSNVCGEKLGYLNGGLNFQIEHHLFPRMSHAHYSTIQPVVQKVCEENGVNYKKFGTILSNLDSMLRQVGALGSVPTEFLEGL

SEQ ID NO: 152 - protein, 439 aa, Artificial Sequence
  delta-4 desaturase 89.2% sequence identity to SEQ ID NO 79
MPPYSRTKVVSDPELSDAKHFTREEILNHTRDKYCILEDGVYDCTNFRDKHPGGDVLDFFPGQDATPHFYMLHRYVWLPSLLSEFKVGSVARDDSYVYHTELHKQICSAVRKVIPMQEWWAPPSWYIKACAILVATLYTDYLWIASGPTIFLGIIIGLLYAAIGLNIQHDANHGSISRNPMVNRLFGYSQDWIGGSRMLWIRQHVVGHHTHCNRHQHDPDIKGGSVITLSRVDLPKEFHHIQQLYFLPLIQLYGFQWVFLGLHDLIEMKWKGEKLSESARKEYAIAIGLRVFFFIRKVVVPFALHFSWYTLLCTYLWVAIGALYLGFFFILSHIFIGAKSLPEDAKNIDWARHQIETSSNVCGEWLGIMNGGLNYQIEHHLFPRMSHAHYAKIQPVVQKVCEENGVNYKHFGTILSNLDSLFRHVKALGSVAVEFMAGL

SEQ ID NO: 153 - protein, 439 aa, Artificial Sequence
  delta-4 desaturase 89.2% sequence identity to SEQ ID NO 79
MPPHSATKVSVPELSDMKHFTREEILNHTNDDYCILEDGVYDLTNFRDKHPGGDFLDLFGGQDATPHFYMLHQRASPPSVLAEYKVGSVDRDDSYVQHTPLMKQIKSAVRKIIPKQEWWAPPSWYIKACALLIATLYTDYYWIASGPTIPLAIVLGLLYAAIGLNIQHDANHGAVSRNPVVNRLFGYSQDWIGGSMMLWIRQHVVNHHTHCNRHQHDPDVKGGSVITLSPYSLPKEWHHIQQYYFLPGEQLLGFQWVFLGLNELIEMKYKGEKLPEIYRKERAIAVGLRVFFFARKFVIPFALHFSWYTLLCTCLWMASAALYLGFFFILSHIFVGAKSLGPDAKNIEWARHQIESSSNVCGEKLGISNGGLNYQIEHHLFPRMSHAHYSPIQPVVQKVCEKNGVNYKKFGTIGSNLDSTFRQVKALGSRAVYEFMEGL

SEQ ID NO: 154 - protein, 439 aa, Artificial Sequence
  delta-4 desaturase 89.2% sequence identity to SEQ ID NO 79
MPPHSRTKVSAPELSDLMKHFTREEILNHTRDKYCIVGDGVYDLTNFRDKHPGGEFLDFFGGQDATPHFYMLHQYEWPPSILAEYKVGSLDRDDSYVHHESLMKQIKSDVRKIMPMQEWWAPPSWYIKACALIVATLYTDYYWIASGPTIPLAIVSGLLYAAIGLNIQHDANHGAVSRNPMVNRLFGYSQDWIGGSRLLWIRQHVVGHHTHCNDHQHDPDVKGGSVLTLSRYSLWMEFHHLQQYYFLPLEQLLGFQWIFLGLHDLIEMRYKGEPLPPSYRKERGIAIGCRVFFFIRKFVVPFALHFSWYTLLCTYLWMAIAALYLGFFFILSHIFIGAKSLPPDANIDWARHQIESSSNVCGDWLGISNGGLNYQIEHHLFPRMNHAHYSKIQPIVQKVCEENGVNYKKFGTILSNLDSMFRQVKALGSVAVYEFMEGL

SEQ ID NO: 155 - protein, 440 aa, Artificial Sequence
  delta-4 desaturase 89.2% sequence identity to SEQ ID NO 79
MPPHARTKVVGDDPELSALMKHFTREEILNHTNDDYCILEDGVYDCSAFRDKHPGGDVLSFFPGQDATPHFYMFHQRESPPAVLAEYKVGSVARDDSYVYHTPLMLQIKSAVRKVMPMGEWWAPPSWWIKACAIIAATLYLDYLWIARGPTIPLAIVSGLLFAAIGLNIQHDANHGSISRNPMVNRLFGYSQDWIGGSRMLWIRQHVVNHHTHCNRHQHDPDVKGGSVIRLSPYSLWKEFHHIQQYYFLPLDQLYGFQWVFLDLHDLIEMKYKGEKLSELYRKERNPAIGLRVFFWARKVVVPFALHPTWYTLLCTYLWMAIAALYLGFFFILSHLFVGVKSLPEDANIDWARHQIESSSNVCGEKLGISNGGLNYQIEHHLFPRMSHSHYSPIQPVVQKVCEENGVNYKKFPTILSNLDSTFRQVKGLGSRAVEFMGGL

SEQ ID NO: 156 - protein, 439 aa, Artificial Sequence
  delta-4 desaturase 89.2% sequence identity to SEQ ID NO 79
MPPHSRTKVSDPELSDMKHFTREKILNHTRDDYCILEDGVYDLTCFRDKHPGGDVLDFFPGQDATPHFYMLHQRASLPSVLSEYKVGSVARDDSYVHHDALMKQIKSAVRGIMPMQEWWAPPSWYIKACAILIATLHTDYYWIASGPTIPLAIVSGLLYAAIGLNIQHDANHGSVSRNPMVNRLFGYSQDWIGGSRVLWIRQHVVGHHTHCNRVQHDPDVKGGSVIRLGRYDLPKEFHHLQQIYFLPGEQLLGFKWVFLGLHDLIEMKYKGEKIPESYRKERNIAIGLRVGFFIRFIALPFALHFSWYTLLCTCLWMAIATLYLGFFFILSHIFVGAKSLPEEGNIEWARHQIESSSNVCGEWLGISNGGLNYQIEHHLFPRLHHAHYSKIQPVVRKVCEENGVNYKKFGTILSNLDAMFRQVKALGSVAVYNEFMEGL

SEQ ID NO: 157 - protein, 439 aa, Artificial Sequence
  delta-4 desaturase 89.2% sequence identity to SEQ ID NO 79
MPPHSGTKVSDPELSDLMKHFTREEILNHTNDKYCILEDGVYDSTCFRDEHPGGEVLDFFPGQDATPGFYELHQYEWLPSVLAEYKVGSVARDDSYVYHTPGMKQIKSAVNKVMPKQEWWAPPSWYIKACAIIAAALYTDYLWIASGPTIPLAIVSGLLFAAIGLNIQHDANHGSVSRNPMVNRLFGYGQDWIGGGRMLWLQQHVVGHHTHCNRVQHDPDVKGGSVLQLSRYDLWKEFHHIQQYYFLPMDALLGFQWVFLGLHDLIEMKYKGEKLPEIYRKDRNIAIGLKVFFFIRKFIIPFALQFSWYTLLCTYLWVCVAAFYLGFFFILSHIFIGAKSLPEDAKNIDWARHQIESSSNVCGEWLGISNGGLNYQIEHHLFPRMSHAHYSKIAPVVQKVCEENGVNYKKFPTIASNLDSLFRQVKALGSVAVEFMEGL

SEQ ID NO: 158 - protein, 439 aa, Artificial Sequence
  delta-4 desaturase 89% sequence identity to SEQ ID NO 79
MPPHSRTKGSDDPELSDLAKHFTRTKKLNHENDKYCILGDGVYDSTCFRDKHPGGDVLDFFPGQDATPHFYMYHQYESLPSVLAEYKVGSIDRDDSYVQHTPLMKQIKADVRKVMPMQEGWAPPSWYIKACAILAATLHLDYLMIARGPTIPLAIVLGLLYAAIGLNIQHDANHGSVSRNPMVNRLFGYSQDWIGGSRLLWIRQHVVGHHLHCNRHQHDPDVKGGGAIRLSRYSLPKEFHHIQQYYFLPLEQLYGFQWVFLGLNDLLEMKYKGEKLPPSCRKERNIAIGLRVFFWIRKFVVPFALHFSWYTLLCIYLWMATAALYLGFFFILSHIFVGAKSLPPDANIDWARRQIESSSNVCGEKLGISNGGLNYQIEHHLFPRMSHAHYSKIQPVVRKVCEENGVNYKKFPTIGSNLDSTFRQVKALGSVPVEFMEGL

SEQ ID NO: 159 - protein, 437 aa, Artificial Sequence
  delta-4 desaturase 89% sequence identity to SEQ ID NO 79
MPPHAGTEVSDPELSDMKHFTREEILNHTNDKICILEDGVYDCTAFRDKHPGGDVLDFFPGQDATPHFWMFHQRESPPSVLAEYKVGSVARDDSYVYHTEGMLQIKSAVRKVMPKQEWWAPPSWYIKACAILAATLYTDYLWILSGPTIFLAIVSGLLYAAIGLNIQHDANHGSVSRNPMVNRLFGYSQDWIGGNMMLWIRKHVVGHHTHCNDHQHDPDVKGGSVITLSPYSGWMEFHHIQQYYFLPLDQLYGFQWVFLGLHELIEWKYKGEKLPEICRKERGIAIGLRVFFWIRKFVVPFALHFSWYTLLCTYLWMAIAALYLAFFFVLSHIFVGAKSLPPDANIDWARHQIESSSNVCGEKLGILNGGLNYQIEHHLFPRMSHSHYSTIQPVVQKVCEENGVNYKHFGTILSNLDSTFRQVKALGSVPIEFMEGL

SEQ ID NO: 160 - protein, 437 aa, Artificial Sequence
  delta-4 desaturase 89% sequence identity to SEQ ID NO 79
MPPHSRTKVGDPELSDMKHFTREEILNHTNDDYCILEDGVYDCNNFRDKHPGGDFLDFFPGQDATPHFYMLHQRESLPSVLAEFKVGSVARDDSYVYHDPGHKQIKCAVRGVMPRQEWWAPPSWYIKACAILAATLYTDYLWIASGPTIPLAIVIGLLYAAIGLNIQHDANHGAVSRNPMVNRLFGYSQDWIGGSRVLWIRQHVVGHHLHCNDVQHDPDIKGGSVITLSPYSGWKEFHHIQQLYFLPLEQLYGFQWVFLGLHDLIEMKYKGEPLPESYRPEYNIAIGLRIFFFARKFVVPFALEFSWYTLLCTYLWMAIAALYLGFFFILSHIFVGVKSLPPDANVDWARHQIENSSNVCGEKLGISNGGLNYQIEHHLFPRMSHAHYSKIQPVVQKVCEENGVNYKKFPTILSNLDSLFKQIKALGAVAVEFMEGL

SEQ ID NO: 161 - protein, 439 aa, Artificial Sequence
  delta-4 desaturase 89% sequence identity to SEQ ID NO 79
MPPHSRTKGSDPELSDAKHFTRERILNDTNDKLCILGDGVYDLTAFRDKHPGGDFLDFFPGQDATPHFYMLHQYEWLPSVLAKYKVGSIARDDSYVHHDPLMKQIKSAVRAVLPRQEWWAPPSWYIKACAILAATLYTDYLWIASGPTIPLAIISGLLYAAIGLNIQHDANHGSVSRNPMVNRLFGYSQDWIGGSRMLWIRQHVVGHHLHTNRHDHDPDVKGGSVLTLSRYSIWKEFHHIQQLYFLPLDQLLGFQWVFLGLHDLIEMRYKGEKLPPSYRPLRNIAIGLRVGFFIRFFVVPFALHFSWYTLLCTYAWMCIGALYLGFFFILSHIFVGAGSLPEDAKNIDWARHQIETSSNVCGEKLGISNGGLNYQIEHHLFPRMSHSHYSPIQPVVQKVCEENGVNYKKFGTILSNLDSLFSQIKALGSVPTYEFMEGL

SEQ ID NO: 162 - protein, 439 aa, Artificial Sequence
  delta-4 desaturase 89% sequence identity to SEQ ID NO 79
MPPHGRTKVSDPELSDMEHFSRTEILNHTNDKLCILEDGVYDLTNFRDKHPGGDYLDFFPGQDATPHFYEFHQYESPPSVMAEYFVGSVARDDSYVYHTPLMKQIKSAVNKVLPMGSWWAPPSWYIKACAILAATLYTDYLMIASGPTIPLAIVSGLLYAAIGLNIQHDANHGGVSRNPMVNRLFGYSQDWIGGSRMLWIRQHVVGHHTHCNRVQHDPDVKGGGVITLSPYSLWMEFHHIQQYYFLPLEVLYGFQWVFLGLHDLIEWKYKGEKLSESYRKDRNPAIGLRVFFFARFFVLPFALEFSWYTLLCTYLWMAIGAFYLGFFFILSHIFIGAKSIPEDAKNIDWVRHQIESSSNVCGEKLGISNGGLNYQIEHHLFPRMSHAHYSKIQPVVQKVCEENGVNYKKFGTIGSNLDSIFKQVKALGSVATYEFMEGP

SEQ ID NO: 163 - protein, 439 aa, Artificial Sequence
  delta-4 desaturase 89% sequence identity to SEQ ID NO 79
MPPHSATKVSDVPELSDLMKHFSREEILNHTNDKICILGDGVYDLTNFRDKHPGGDVIDFFPGQDATPHFYMLHQYESPPSVLAEYKVGSVARDDSYVYHDPLMKRICSAVRKVMPMQEWWAPPSWWIKACALLAATLYTDYLWLASGPTIPLAIVLGLLYAAIGLNIQHDANHGSVSRNPMVNRLFGYSQDWIGGSRMLWIRQHVVGHHIHTNRHQHDPDVKGGSAIRLSPTSLPKEFHHIQQYYFLPLIQLLGFQWVFLGANDLIEMKYEGEKLPESYRPERNIAIGCRVFFFIRKFIVPFALEFTWYTLLCTYLWMATAALYLGFFFILSHIFIGAKSLGPDGNIDWARHQIENSSNVGGEKLGISNGGLNYQIEHHLFPRMHHAHYSTIQPVVQKVCEEMGVNYKKFGTIGSNLDSTLRQVKGLGSVPTEFMEGL

SEQ ID NO: 164 - protein, 438 aa, Artificial Sequence
  delta-4 desaturase 89% sequence identity to SEQ ID NO 79
MPPHSRRKVGSDPELRDMKHFTREEILNHNNDKYCILEDGVYDLTNFRDKHPGGDVLDFFPGQDATPHFYMLHQRESLPSILAEYKVGSVARDDSYVYATSLMKRIKSEVRGVMPMGSWWAPPSWYIKACAILAATLYLDYLWIASGPTIPLAIVSGLLFAAIGLNIQHDANHGSVSRNPAVNRLFGYSQDWIGGNRMLWIREHVVGHHLHTNRHQHDPDIKGGSVLQLSRVSIPKEFHHIQQYYFLPLIQLYGFQWVFLGLHDLIEMKYKGEPLPPSYRKERNIAIGCRLFFFIRKFVVPFALHFSWYTLLCVCLWMAIGALYLGFFFVLSHIFIGAKSLPEDGNIDWARHQIESSSNVCGEKLGIMNGGLNYQIEHHLFPRMSHAHYAKIAPVVQKVCEENGVNYKKFGTIGSNLDSTFRQIGALGSVAVEFMEGL

SEQ ID NO: 165 - protein, 439 aa, Artificial Sequence
  delta-4 desaturase 88.8% sequence identity to SEQ ID NO 79
MPPHSRTKVSDPELSDLMKHFTREEILGDTNDDYCILGDGVYDLTNFRDKHPGGDYLDFFPGQDATPHFYQLHQYEWPPSVLAEFGVGSVARDDSYVHHTPLMKRIKSAVNKVMPRQEWWAPPSWWIKACAILAATLYTDYLWIASGPTILLAIVIGLLYAAIGLNIQHDANHGSVSRNPMVNRLFGYSQDWIGGSMMLWLRQHVVGHHTHCNDHQHDPDVKGGSVLTLSRYSLPMEFHHIQQIYFLPLEQLLGFQWVFLDLHDLIEMKYKGEKLPESYRKERNIAIGCRIFFFVRKFVVPFALHPSWYTLLCTYLWMATAALYLGFFFILSHIFVGIKSLPEDANIDWARHQIESSSNVCGDKLGYINGGLNYQIEHHLFPRLSHAHYSKIQPVVQKVCEKNGVNYKHFPTIASNLGSTFRQLGALGAVAVYEFMGGL

SEQ ID NO: 166 - protein, 437 aa, Artificial Sequence
  delta-4 desaturase 88.8% sequence identity to SEQ ID NO 79
MPPHSRTKVSDPELSDMEHFTREEILNHTNDKLCILEDGVYDLTNFRDKHPGGDVLDFFPGQDATPHFYMFHRYESLPSVLAEYKVGSIARDDSYVYATELMKQIKSAVRKVIPMQEGWAPPSWYIKACAILIATLYLDYLWLLSGPTIPLAIVSGLLYAAIGLNIQHDANHGSVSRNPMVNRLFGYGQDWIGGSRLLWIRQHVVGHHTHCNRHQHDPDVKGGSVIQLSRYDGWMEFHAIQQYYFLPLEQLYGFKWVFLGAHDLIEMKWEGEKLPELYRKERNIAIGLRVFFFARKFVIPFALHFSWYTLLCVYLWVAIAALYLGFFFILSHIFVGAKSLPEDGSVEWARHQIESSSNVCGEKLGISNGGLNYQIEHHLFPRMSHAHYSKIQPVVQKVCEEMGVNYKKFGTIGSNLGSTFQQVGALGAVAVEFMEGL

SEQ ID NO: 167 - protein, 438 aa, Artificial Sequence
  delta-4 desaturase 88.8% sequence identity to SEQ ID NO 79
MPPHSATKVVSAPELSDMKHFSREKILNHENDKICILEDGVYDLTNFRDKHPGGDVLDLFPGQDATPHFYMLHQYESLPSVMAEYKVGSVARDDKYVHHTPLMKQIKSEVRKVMPMQEWWAPPSWYIKACAILAATLYTDYLWIASGPTIPLAIVSGLLFAAIGLNIQHDANHGSVSRNPMVNRLFGYSQDWIGGNRMLWIRQHVVGHHLHSNRHDHDPDLKGGSVIQLSRYSLPKEFHHLQQYYFLPLIQLYGFQWVFLGAHDLIEWRWKGEKLPPSYRPEFNIAIGCRIFFFIRKFVVPFALHPSWYTLLCTYLWMATAALYLGFFFILSHLFVGVKSLPEDANIEWARRQIESSSNVGGEKLGILNGGLNYQIEHHLFPRMSHAHYSPIQPVVQKVCEENGVNYKKFGTIGSNLGSTFRQVKALGSRATEFLEGL

SEQ ID NO: 168 - protein, 438 aa, Artificial Sequence
  delta-4 desaturase 88.8% sequence identity to SEQ ID NO 79
MPPHSRRKVSDAPELRDMKHFSREEILDHNNDKYCILEDGVYDLTAFRDKHPGGEVLDFFPGQDATPHFYMYHQYESPPSVLAEYKVGSVARDDSFVYHTELMKQICAAVNKVMPMQSWWAPPSWYIKACALLAATLYLDYLWIASGPTILLAIVSGLLYAAIGLNIQHDANHGALSRNPMVNRLFGYSQDWIGGSRMLWIRQHVVNHHTHCNRHDHDPDVKGGSVIQLKRYSLPLPFHHIQQYYFLPLIQLLGFQWVFLGLHELIEMKYKGEKLPELYRPERNIAIGCRVFFFIRKFAVPFALHFSWHTLLCTYLWMAIAAFYLCFFFILSHIFVGAGSLGEEANIDWARHQIESSSNVCGEKLGISNGGLNYQIEHHLFPRMSHAHYSKIQPVVQKVCEEMGVNYKKFGTILSNLDSTLRQVKALGSVPVEYMAGL

SEQ ID NO: 169 - protein, 439 aa, Artificial Sequence
  delta-4 desaturase 88.5% sequence identity to SEQ ID NO 79
MPPHSRSEVSDDPELSDLMKHFTREEILNHTNDDLCILGDGVYDLTNFRDKHPGGEVLDFFPGRDATPHFFMLHQREWLPSVLAEYKVGSVARDDSYVYHEPGMKQIKSAVRKVMPMQEGWAPPSWYIKACAILVATLYTDYLWIASGPTIFLAIVSGLLYAAIGLNIQHDANHGSVSRNPMVNRLFGYSQDWIGGSRMLWIRQHVVGHHTHCNRIQHDPDVKGGSAIQLSRYSLWMEWHHIQQIYFLPLDQLLGFQWIFLGLHDLIEWKYEGEPLPESYRKERNPAIGLRVFFFIRKFVIPFALHPSWYTLLCTCLWMATASLYLGFFFILSHIFVGAKSLPEDASVEWARHQIETSSNVGGEKLGISNGGLNFQIEHHLFPRMSHAHYSKIQPVVQKVCEENGINYKHFGTILSNLGSTFRQVKALGSVPVEFMAKL

SEQ ID NO: 170 - protein, 437 aa, Artificial Sequence
  delta-4 desaturase 88.3% sequence identity to SEQ ID NO 79
MPPHGRTKVGDPELSDMKHFTREEILNHTNDKYCILEDGVYDASAFRDKHPGGDFLDFFPGQDATPGFYMFHQHEWPPSVLAEYKVGSVARDDSYVYHTPLMKQICSAVRKVMPKGEWWAPPSWYIKACAILAATLYLDYLWIASGPTIPLAIVIGLLYAAIGLNIQHDANHGAVSRNPMVNRLFGYSQDWIGGSRLLWIRQHVVGHHTHCNDVQHDPDLKGGSVITLSRTSLPKEFHHLQQYYFLPLEALYGFQWVFLGLHDLIEMKYKGEKLSPSYRKLRNIAIGLRIFFFARKFVIPFALHFSWYTLLCTCAWMATATLYLGFFFILSHIFVGAKSLPEDGNVDWARHQIESSSNVCGEKLGHLNGGLNYQIEHHLFPRMSHAHYSTIEPVVQKVCEENGVKYKKFGTILSNLDSTFKQVKALGSVAVEFMEGL

SEQ ID NO: 171 - protein, 438 aa, Artificial Sequence
  delta-4 desaturase 88.3% sequence identity to SEQ ID NO 79
MPPHSRKKGSDPELSDLAKHFTRERILNHTRDKYCILEDGVYDLTNFRDKHPGGDVLDFFPGQDATPHFYMLHQYEWPPSVLARYGVGSVARDDSYVYADPLMLQICSAVNKVIPMQEWWAPPSWWIKACAILVATLFTDYLWLAKGPTIPLAIVSGLLFAAIGLNIQHDANHGSVSRNPMVNRLFGYSQDWIGGSRMLWLRQHVVGHHTHCNRIDHDPDVKGGSVIRLSRYSLPKEFHHIQQIYFLPLIQLLGFQWVFLGLHDLIEMRYKGEKLPESYRKERNPAVGLRIFFFARKFVIPFALHFSWYTLLCTCAWMAIAALYLGFFFILSHIFVGIKSLGPDANVDWARHQIESSSNVCGEWLGILNGGLNYQIEHHLFPRMNHAHYSKIQPIVQKVCEENGVNYKHFGTILSNLDSTFRQIKALGSRAVEFMEGL

SEQ ID NO: 172 - protein, 440 aa, Artificial Sequence
  delta-4 desaturase 88.3% sequence identity to SEQ ID NO 79
MPPHSRTKGSDVAELSDLMKHFTRTEIANHTRDKYCILEDGVYDANNFRDKHPGGDVIDIFPGQDATPHFFELHQYASPPSVLSEYKVGSVARDDSYVYHTPLMKQIKSAVRKVMPKGEGWAPPSWYIKACAILAATLYLDYYWIARGPTIPLAIVSGLLYAAIGLNIQHDANHGSVSRNPMVNRLFGYSQDWIGGSRMLWIRQHVVGHHTHCNRHDHDPDVKGGSVITLSRYSIPKEWHHIQQLYFLPLIQLYGFQWVFLDLHDLIEMKWEGEPLPESYRKERNPAIGLRLFFFVRKIVVPFALHFSWYTLLCTYLWMAIGALYLCFFFILSHNFVGIKSIPEDASIDWARHQIESSSNVGGEWLGYLNGGLNYQIEHHLFPRMSHAHYSKIQPVVQKVCEENGVNYKKFGTILSNLDSTFRHVKALGAVAVYEFMEGL

SEQ ID NO: 173 - protein, 440 aa, Artificial Sequence
  delta-4 desaturase 88.3% sequence identity to SEQ ID NO 79
MPPHGRTKVSDVPELSDLAKHFSREEILNHTNDKYCILEDGVYDATNFRDKHPGGDVIDFFPGRDATPHFWMLHRYEWPPSVLAEYGVGSVARDDKFVHHTALMKQIKSAVRAVLPMQEWWAPPSWYIKACAILAATLFTDYLWIASGPTIPLAIVLGLLYAWIGLNIQHDANHGSVSRNPVVNRLFGYSQDWIGGGRMLWIRQHVVGHHTHCNRHDHDPDVKGGSVITLKRVSLPLEWHHIQQYYFLPLIQLLGFQWVFLGLNDLIEWKYKGEKLSEICRKERNIAIGLRVFFFVRKFVVPFALHFSWHTLLCTYLWMAIAALYLGFFFILSHIFVGAKSLGEDANIDWARHQIETSSNVGGDKLGYSNGGLNYQIEHHLFPRMNHAHYAKIQPVVQKVCEENGVKYKHFGTILSNLDSTFKQVKALGSVAVYEFLAGL

SEQ ID NO: 174 - protein, 440 aa, Artificial Sequence
  delta-4 desaturase 88.3% sequence identity to SEQ ID NO 79
MPPHAGTKVSDDPELRDLMKHFTREEILNHTNPKYCILGDGVYDATNFRDKHPGGDVLDFFPGQDATPGFYMFHQYESLPGLLARYKVGSVARDDSYTHHDPLMKQLCSAVRKVMPMQEWWAPPSWYIKACAILIATLYLDYLMIASGPTIPLAIVLGLLFAAIGLNIQHDANHGSVSRNPMVNRLFGYAQDWIGGSRMLWIRQHVVGHHTHCNDVQHDPDVKGGSVIQLSRYSLPKPFHHLQQYYFLPLEQLYGFQWVFLGLHDLIEMKYKGEKLPESYRKEFNPAIGLRVGFFIRFFVVPFALQFSWYTLLCTCLWMAVAAFYLGFFFILSHIFVGVKSLPEDANIDWARHQIESSSNVCGEKLGISNGGLNYQIEHHLFPRLSHAHYAPIQPVVQKVCEDNGINYKKFGTILSNLDSTFRQVKALGAVATYEFLAGL

SEQ ID NO: 175 - protein, 439 aa, Artificial Sequence
  delta-4 desaturase 88.3% sequence identity to SEQ ID NO 79
MPPHSRTKVSDPELSDLMKHFTREEILNHNNDKYCILEDGVYDLTNFRDKHPGGDVLDLFPGQDATPGFYMLHQHVSLPSVLAEYKVGSVDRDDSYVYHTPLQKQLCSAVRKVIPMQEWWAPPSWYIKACAILAATLYTDYLWIASGPTIPLAIVSGLLYAAIGLNIQHDANHGGVSRNPAVNYLFGYAQDWIGGGRMLWIQKHVVNHHIHTNDVQHDPDVKGGSAIKLKRYSLWKEFHHIQQYYFLPLIQLLGFQWVFLGLHDLIEMKYKGEPLPPSARPERGIAIGLRVFFFIRKFVLPFALHFSWYTLLCIYLWMAIAALYLGFFFVLSHIFVGAKSLPPDANIDWARHQIESSSNVCGEKLGISNGGLNYQIEHHLFPRMNHAHYSKIQPIVQRICEDNGVNYKKFPTIGSNLDSLFSQVKALGSVAIYEFMGGL

SEQ ID NO: 176 - protein, 439 aa, Artificial Sequence
  delta-4 desaturase 88.1% sequence identity to SEQ ID NO 79
MPPHSRKKVGSDPELSDMKHFTREEKLNHTNDKYCILGDGVYDLTNFRDKHPGGDVLSFFPGQDATPHFFMLHRKESPPSVLAEYKVGSVERDDKYTYHTPLMKQIKAAVRKVMPRGEWWAPPSWYIKACAILAATLYTDWLWLASGPTIPLAIVSGLLYAAIGLNIQHDANHGSISRNPVVNRLFGYSQDWIGGSMMLWIREHVVGHHTHCNRHQHDPDVKGGSVITLSPTDLWLPFHHIQQYYFLPLDQLYGFQWVFLGLHELIEMKYKGEPLPESYRKERNPAIGCKVFFFIRKFAVPFWLQPSWYTLLCVYLWMAIAAFYLGFFFILSHIFVGAKSIPEDAKSIDWARHQIESSSNVCGEKLGISNGGLNYQIEHHLFPRMSHAHYSKIQPVVQRVCEENGINYKKFGTIGSNLDSLLRQVKALGSVAVEFMEGL

SEQ ID NO: 177 - protein, 439 aa, Artificial Sequence
  delta-4 desaturase 88.1% sequence identity to SEQ ID NO 79
MPPHSRTKVSDPELSDLMKHFTREEILNHTNDKICILEDGVYDATNFRDKHPGGDVLDIFPGQDATPHFYMLHQRESPPGLLAKYKVGSVARDDSYVYHEPLMKQIKCEVNKVLPKQEWWAPPSWYIKACAILVATLYLDYYWIARGPTIPLAIVSGLLYAAIGLNIQHDANHGSVSRNPAVNRLFGYSQDWIGGSRMLWIRKHVVGHHLHCNRHQHDPDVKGGSVLTLSPYSLPKEFHHIQQLYFLPLIVLYGFKWVFLGLHDLIEMRYKGEKLPELYRKEFNIAIGLRLFFFIRKFVVPFALHPSWHTLLCTCLWVASAALYLGFFFILSHIFVGAGSLPEDASIDWARHQIESSSNVGGEKLGISNGGLNYQIEHHLFPRMSHAHYSKIQPVVQKVCEENGINYKKFGTILSNLDSLFRHLGAIGSRATYEFMEGL

SEQ ID NO: 178 - protein, 439 aa, Artificial Sequence
  delta-4 desaturase 87.9% sequence identity to SEQ ID NO 79
MPPHGRTEGGDPELSDMKHFTYEEILNHTRDKICIVEDGVYDLTNFRDKHPGGDVVDLFGGQDATPHFYMLHQYESPPSILAEYKVGSIARDDSYVYHTPGMKRIKAEVRKVMPKGEWWAPPSWYIKACAILAAALYTDYLWIASGPTIPLAIVSGLLYAWIGLNIQHDANHGSVSRNPMVNRLFGYSQDWIGGSRMLWIQQHVVGHHIHCNRVQHDPDVKGGSVIKLSPYSLPMEFHHIQQYYFLPLEQLYGFQWVFLGLHDLLEWKYKGEKIPEIARKERGIAIGLRVFFFVRKFVVPLALEFTWHTLLCTYLWMCVAAFYLGFFFILSHIFVGIGSLPEDAKNIDWARHQIESSSNVCGEKLGYSNGGLNYQIEHHLFPRMSHAHYSKIQPVVQKVCEENGVNYKKFGTILSNLDSMFRQVKALGSVAVYEFMEGL

SEQ ID NO: 179 - protein, 437 aa, Artificial Sequence
  delta-4 desaturase 87.9% sequence identity to SEQ ID NO 79
MPPHSRTKVSDPELRDMKHFTRTEILNHTRDKYCILGDGVYDLTCFRDKHPGGDVLDFFPGQDATPHFYMLHQYEWPPAVLAEYKVGSVARDDSYVHHTPLMKQIKSEVRKVMPMQEWWAPPSWYIKACALLVAALYTDYLMIASGPTIPLAIVSGLLYAAIGLNIQHDANHGAVSRNPMVNRLFGYSQDWIGGSRMLWIREHVVGHHLHCNRIQHDPDVKGGSAIRLSRYSLWKPWHHLQQIYFLPLIQLLGFKWVFLDLHDLIEMKYKGEKLPELYRPLRNIAIGCRIFFFIRKFALPFWLHFTWYTLLCTCLWMAIASLYLAFFFILSHIFVGIKSLGEDANIDWARHQIESSSNVGGDKLGYSNGGLNYQIEHHLFPRMSHAHYSKIEPVVQKVCEENGVNYKKFPTILSNLDSTFRQVKALGSVAVEFMEGL

SEQ ID NO: 180 - protein, 437 aa, Artificial Sequence
  delta-4 desaturase 87.9% sequence identity to SEQ ID NO 79
MPPHSRTKVSDPELKDMKHFAREEILNHTNDKYCILEDGVYDLTNFRDKHPGGDVLDFFPGQDATPHFYMLHRYAWPPSVLAEYKVGSVDRDDSYVYHTSLYLQIKSAVRKVIPMQEWWAPPSWWIKACALLAATLYTDYLMIASGPTIPLGIVSGLLYAAIGLNIQHDANHGSVSRNPMVNRLFGYSQDWIGGSRMLWIREHVVGHHTHCNRHQHDPDVKGGGVLKLSRYDIWMEFHHIQQLYFLPLEQLLGFQWVFLGLHDLIDMKWKGEKLSESARPERGIAIGLRVFFWIRKFVVPFALHFSWYTLLCTYAWVASAAFYLGFFFILSHIFVGAKSLPPDASVDWARHQIETSSNVGGEKLGISNGGLNYQIEHHLFPRMSHAHYSKIQPVVQKVCEENGVNYKKFPTIASNLDSTFSQVKALGSVAVEFMGGI

SEQ ID NO: 181 - protein, 438 aa, Artificial Sequence
  delta-4 desaturase 87.4% sequence identity to SEQ ID NO 79
MPPHARSKVSDPELSDMKHFTRERILNDENDKICILEDGVYDLTNFRDKHPGGDYVDFFGGQDATPHFYMFHQYESPPSVLAEYKVGSVARDDSFVYHEPLMKQIKSAVRKVMPRGEWWAPPSWYIKACAILAATLYTDYLWIARGPTIPLAIVLGLLFAAIGLNIQHDANHGSLSRNPMVNRLFGYSQDWIGGSRLLWLREHVVGHHTHCNRHDHDPDVKGGGVLKLSRSSLPMEFHHIQQIYFLPLEQLLGFQWVFLGLHDLIEMKYKGEPLPELYRKERNIAVGLRVFFFIRKFVVPFALHPSWHTLLCICLWMAIGALYLGFFFILSHIFVGIKSLPEDAKNIDWARHQIESSSNVCGEKLGHSNGGLNYQIEHHLFPRMSHSHYSKIEPVVQKVCEDNGINYKKFGTILSNLDSTLRQLGALGSRPVEFMEGL

SEQ ID NO: 182 - protein, 439 aa, Artificial Sequence
  delta-4 desaturase 87.4% sequence identity to SEQ ID NO 79
MPPHSRTKVVSDPELSDMEHFTRTEILNHENDKYCILEDGVYDLSNFRDKHPGGEYLDFFPGQDATPGFFQLHQYASLPGVLARYKVGSIDRDDSYVQHTSLMKQICSAVRKVMPRGEWWAPPSWWIKACAIIIATLYLDYLWIASGPTIPLAIVSGLLFAAIGLNIQHDANHGALSRNPMVNRLFGYAQDWIGGSMMLWIQQHVVGHHTHCNRVQHDPDVKGGGVITLSPTSLPLEFHHIQQYYFLPLIQLLGFQWVFLGLHDLIEMKYKGEKLPESARKEYGIAIGLKVFFWIRKVVVPFWLHFSWYTLLCIYLWMAIGALYLAFFFILSHIFVGAKSLPEDGKNIDWARHQIESSSNVCGEKLGISNGGLNYQIEHHLFPRMSHSHYSKIQPVVQKVCEENGINYKKFGTILSNLDSIFRQVGALGSVAVEFLEGL

SEQ ID NO: 183 - protein, 439 aa, Artificial Sequence
  delta-4 desaturase 87.2% sequence identity to SEQ ID NO 79
MPPHSRTKGSDDPELSDLMKHFTREKILNDNNDKYCIVGDGVYDATNFRDKHPGGEFLDFFPGQDATPHFYMFHQYESLPSILAEYKVGSLERDDSYTYHDSLMKQIKSAVRKVIPMQEWWAPPSWYIKACAILIATLYLDYLWIASGPTIFLAIVLGLLYAWIGLNIQHDANHGSVSRNPMVNRLFGYSQDWIGGSRVLWIRQHVVGHHIHSNRHQHDPDVKGGGVITLSRVSLPKEFHHIQQYYFLPLEQLLGFKWVFLGLHDLIDMKYKGEKLPESYRKERGIAIGCRVGFFARKIVVPFALQFSWHTLLCVYLWVAIATLYLAFFFILSHIFIGAKSLPPDANIDWARHQIESSSNVCGEKLGIMNGGLNYQIEHHLFPRMSHAHYSTIQPVVQRVCEENGVNYKHFGTIGSNLDSTFRQVKALGSVAVEFLEGL

SEQ ID NO: 184 - protein, 439 aa, Artificial Sequence
  delta-4 desaturase 87% sequence identity to SEQ ID NO 79
MPPHAATEVSVPELSDLMKHFSRTEILNDTRDKYCILEDGVYDLPNFRDKHPGGDYVDFFPGQDATPHFYMLHQYEWPPSVLAEYGVGSVARDDSFVHHDPLMLQLCSDVRKVMPMGEWWAPPSWWIKACAILAATLYLDYLWLASGPTIPLAIISGLLYAAIGLNIQHDANHGSVSRNPMVNRLFGYSQDWIGGSRMLWIRQHVVGHHIHCNRHQHDPDVKGGGVITLSRYDLPMEFHHLQQLYFLPLIALLGFQWVFLGLHDLIEWKYKGEKLPEIYRKERGIAIGLRVFFWARFFVVPFALEFSWYTLLCTYLWMAIAALYLGFFFILSHIFVGAKSLPEDASIDWARRQIETSSNVGGEWLGIINGGLNFQIEHHLFPRMSHAHYSTIQPVVQKVCEENGVNYKKFGTIGSNLDSTFKQVKALGSVPVYEFMAGL

SEQ ID NO: 185 - protein, 437 aa, Artificial Sequence
  delta-4 desaturase 87% sequence identity to SEQ ID NO 79
MPPHSRTKVSVPELSDMKHFTREEILNDTNDDYCILEDGVYDLTNFRDKHPGGDFIDIFPGRDATPHFYMYHQRESPPSVLSEYKVGSLERDDSFVHYTALMKQLKSEVNKIMPMGEGWAPPSWYIKACALLVATLYTDYLMIAKGPTIPLSIVIGLLYAWIGLNIQHDANHGSVSRNPMVNRLFGYSQDWIGGSRMLWIQQHVVGHHIHCNRIQHDPDVKGGSVIRLSRYSLWKEFHHIQQYYFLPLEQLLGFQWVFLGLNDLIDMKWKGEKLPESARKERNIAIGLKVFFFIRKFVVPFALQFSWYTLLCTYAWMAIAALYLGFFFILSHIFVGAKSLPEEANIDWARHQIESSSNVCGEWLGHLNGGLNYQIEHHLFPRMSHAHYSKIQPVVQKVCEENGVKYKKFGTILSNLDSTFRQVKALGSVPIEFMEGL

SEQ ID NO: 186 - protein, 439 aa, Artificial Sequence
  delta-4 desaturase 85.4% sequence identity to SEQ ID NO 79
MPPHSRTKVSDDAELKDLMKHFAREEKLNHTNDKLCILEDGVYDLPNFRDEHPGGDVLSFFPGRDATPHFYQLHQKESPPALLAEYKVGSVARDDSYVQYTPLHLQICADVNKVMPRQEWWAPPSWWIKACALLAATLYTDYLWIASGPTIPLSIVLGLLFAWIGLNIQHDANHGGVSRNPMVNRLFGYGQDWIGGSRMLWIQQHVVGHHTHCNRHQHDPDVKGGSVLKLSRYDLWLEWHHIQQYYFLPGEQLYGFQWVFLGLHELIEMKYKGEKLPESCRKERNPAIGLRVGFWIRKIVVPFALHFSWYTLLCTCLWMAIGSLYLGFFFVLSHIFVGAKSLPEDASIDWARRQIESSSNVCGDKLGISNGGLNYQIEHHLFPRMSHAHYSKIQPVVQKVCEDDGVNYKKFGTILSNLDSTFRQLKALGSVPVEFLEGL

SEQ ID NO: 187 - protein, 5 aa, Artificial Sequence
  Synthetic Polypeptide
KHPGG

SEQ ID NO: 188 - protein, 5 aa, Artificial Sequence
  Synthetic Polypeptide
QHPGG

SEQ ID NO: 189 - protein, 5 aa, Artificial Sequence
  Synthetic Polypeptide
RHPGG

SEQ ID NO: 190 - protein, 6 aa, Artificial Sequence
  Synthetic Polypeptide
KHPGGD

SEQ ID NO: 191 - protein, 6 aa, Artificial Sequence
  Synthetic Polypeptide
QHPGGD

SEQ ID NO: 192 - protein, 6 aa, Artificial Sequence
  Synthetic Polypeptide
RHPGGD

SEQ ID NO: 193 - protein, 11 aa, Artificial Sequence
  Synthetic Polypeptide
GLNIQHDANHG

SEQ ID NO: 194 - protein, 6 aa, Artificial Sequence
  Synthetic Polypeptide
HVVGHH

SEQ ID NO: 195 - protein, 14 aa, Artificial Sequence
  Synthetic Polypeptide
AAIGLNIQHDANHG

SEQ ID NO: 196 - protein, 7 aa, Artificial Sequence
  Synthetic Polypeptide
QHVVGHH

SEQ ID NO: 197 - protein, 5 aa, Artificial Sequence
  Synthetic Polypeptide
EHPGG

SEQ ID NO: 198 - protein, 6 aa, Artificial Sequence
  Synthetic Polypeptide
HVVMHH

SEQ ID NO: 199 - protein, 7 aa, Artificial Sequence
  Synthetic Polypeptide
EHVVMHH

SEQ ID NO: 200 - protein, 4 aa, Artificial Sequence
  Synthetic Polypeptide
HPGG

SEQ ID NO: 201 - protein, 6 aa, Artificial Sequence
  Synthetic Polypeptide
QDWIGG

SEQ ID NO: 202 - protein, 5 aa, Artificial Sequence
  Synthetic Polypeptide
NGGLN

SEQ ID NO: 203 - protein, 9 aa, Artificial Sequence
  Synthetic Polypeptide
QIEHHLFPR

SEQ ID NO: 204 - protein, 12 aa, Artificial Sequence
  Synthetic Polypeptide
  misc_feature (9)..(9): Xaa can be any naturally occurring amino acid
IGLNIQHDXNHG

SEQ ID NO: 205 - protein, 5 aa, Artificial Sequence
  Synthetic Polypeptide
  misc_feature (4)..(4): Xaa can be any naturally occurring amino acid
DPDXK

SEQ ID NO: 206 - protein, 15 aa, Artificial Sequence
  Synthetic Polypeptide
  misc_feature (6)..(6): Xaa can be any naturally occurring amino acid
NGGLNXQIEHHLFPR

SEQ ID NO: 207 - protein, 9 aa, Artificial Sequence
  Synthetic Polypeptide
  misc_feature (3)..(3): Xaa can be any naturally occurring amino acid
GYXQDWIGG

SEQ ID NO: 208 - protein, 12 aa, Artificial Sequence
  Synthetic Polypeptide
IGLNIQHDANHG

SEQ ID NO: 209 - protein, 6 aa, Artificial Sequence
  Synthetic Polypeptide
  misc_feature (3)..(3): Xaa can be any naturally occurring amino acid
YLXFFF

SEQ ID NO: 210 - protein, 8 aa, Artificial Sequence
  Synthetic Polypeptide
  misc_feature (4)..(4): Xaa can be any naturally occurring amino acid
  misc_feature (7)..(7): Xaa can be any naturally occurring amino acid
HVVXHHXH

SEQ ID NO: 211 - protein, 7 aa, Artificial Sequence
  Synthetic Polypeptide
  misc_feature (2)..(2): Xaa can be any naturally occurring amino acid
  misc_feature (4)..(4): Xaa can be any naturally occurring amino acid
FXGXDAT

SEQ ID NO: 212 - protein, 5 aa, Artificial Sequence
  Synthetic Polypeptide
  MISC_FEATURE (4)..(4): Xaa is Val, Ile, Leu, Met, Ala Thr, or Gln
DPDXK

SEQ ID NO: 213 - protein, 15 aa, Artificial Sequence
  Synthetic Polypeptide
  MISC_FEATURE (6)..(6): Xaa is Phe, Trp, or Tyr
NGGLNXQIEHHLFPR

SEQ ID NO: 214 - protein, 9 aa, Artificial Sequence
  Synthetic Polypeptide
  MISC_FEATURE (3)..(3): Xaa is Ala, Ser, Gly, or Met
GYXQDWIGG

SEQ ID NO: 215 - protein, 4 aa, Artificial Sequence
  Synthetic Polypeptide
  MISC_FEATURE (2)..(2): Xaa is Phe or Ile
YXLP

SEQ ID NO: 216 - protein, 6 aa, Artificial Sequence
  Synthetic Polypeptide
  MISC_FEATURE (3)..(3): Xaa is Ala or Gly
YLXFFF

SEQ ID NO: 217 - protein, 8 aa, Artificial Sequence
  Synthetic Polypeptide
  MISC_FEATURE (4)..(4): Xaa is Gly, Asn, Ala, Ser, Lys, Asp, Trp, or Met
  MISC_FEATURE (7)..(7): Xaa is Leu, Ile, Phe, or Thr
HVVXHHXH

SEQ ID NO: 218 - protein, 4 aa, Artificial Sequence
  Synthetic Polypeptide
  MISC_FEATURE (3)..(3): Xaa is Pro or Ala
APXS

SEQ ID NO: 219 - protein, 4 aa, Artificial Sequence
  Synthetic Polypeptide
  MISC_FEATURE (2)..(2): Xaa is Trp or Phe
  MISC_FEATURE (3)..(3): Xaa is Ala, Val, Cys, Gly, Ser, Pro, or Ile
FXXR

SEQ ID NO: 220 - protein, 7 aa, Artificial Sequence
  Synthetic Polypeptide
  MISC_FEATURE (2)..(2): Xaa is Gly or Pro
  MISC_FEATURE (4)..(4): Xaa is Arg or Gln
FXGXDAT

SEQ ID NO: 221 - protein, 4 aa, Artificial Sequence
  Synthetic Polypeptide
  MISC_FEATURE (2)..(2): Xaa is Leu, Ile, Met, Val, Phe, Cys, or Ala
  MISC_FEATURE (3)..(3): Xaa is Leu, Ile, Val, Cys, or Ala
TXXC

SEQ ID NO: 222 - protein, 4 aa, Artificial Sequence
  Synthetic Polypeptide
  MISC_FEATURE (2)..(2): Xaa is Leu or Phe
  MISC_FEATURE (3)..(3): Xaa is Trp or Ala
PXXL

SEQ ID NO: 223 - protein, 4 aa, Artificial Sequence
  Synthetic Polypeptide
  MISC_FEATURE (3)..(3): Xaa is Cys or Ala
KAXA

SEQ ID NO: 224 - protein, 5 aa, Artificial Sequence
  Synthetic Polypeptide
  MISC_FEATURE (2)..(2): Xaa is Val or Leu
  MISC_FEATURE (3)..(3): Xaa is Gly, Ala, Asp, or Glu
  MISC_FEATURE (5)..(5): Xaa is Gly or Ala
IXXDX

SEQ ID NO: 225 - protein, 5 aa, Artificial Sequence
  Synthetic Polypeptide
  MISC_FEATURE (4)..(4): Xaa is Val or Gln
DPDXK

SEQ ID NO: 226 - protein, 15 aa, Artificial Sequence
  Synthetic Polypeptide
  MISC_FEATURE (6)..(6): Xaa is Tyr or Phe
NGGLNXQIEHHLFPR

SEQ ID NO: 227 - protein, 9 aa, Artificial Sequence
  Synthetic Polypeptide
  MISC_FEATURE (3)..(3): Xaa is Ser, Ala, or Met
GYXQDWIGG

SEQ ID NO: 228 - protein, 8 aa, Artificial Sequence
  Synthetic Polypeptide
  MISC_FEATURE (4)..(4): Xaa is Gly or Met
  MISC_FEATURE (7)..(7): Xaa is Leu or Thr
HVVXHHXH

SEQ ID NO: 229 - protein, 4 aa, Artificial Sequence
  Synthetic Polypeptide
  MISC_FEATURE (2)..(2): Xaa is Phe or Trp
  MISC_FEATURE (3)..(3): Xaa is Ala or Ile
FXXR

SEQ ID NO: 230 - protein, 4 aa, Artificial Sequence
  Synthetic Polypeptide
  MISC_FEATURE (2)..(2): Xaa is Leu or Ala
  MISC_FEATURE (3)..(3): Xaa is Leu or Ala
TXXC

SEQ ID NO: 231 - protein, 4 aa, Artificial Sequence
  Synthetic Polypeptide
  MISC_FEATURE (2)..(2): Xaa is Leu or Phe
  MISC_FEATURE (3)..(3): Xaa is Ala or Trp
PXXL

SEQ ID NO: 232 - protein, 4 aa, Artificial Sequence
  Synthetic Polypeptide
  MISC_FEATURE (3)..(3): Xaa is Ala or Cys
KAXA

SEQ ID NO: 233 - protein, 5 aa, Artificial Sequence
  Synthetic Polypeptide
  MISC_FEATURE (2)..(2): Xaa is Val or Leu
  MISC_FEATURE (3)..(3): Xaa is Gly or Glu
  MISC_FEATURE (5)..(5): Xaa is Gly or Ala
IXXDX

SEQ ID NO: 234 - protein, 11 aa, Artificial Sequence
  Synthetic Polypeptide
  misc_feature (8)..(8): Xaa can be any naturally occurring amino acid
GLNIQHDXNHG

SEQ ID NO: 235 - protein, 437 aa, Artificial Sequence
  Synthetic Polypeptide
  MISC_FEATURE: Q6VPV2_PAVLU
MPPSAASEGGVAELRAAEVASYTRKAVDERPDLTIVGDAVYDAKAFRDEHPGGAHFVSLFGGRDATEAFMEYHRRAWPKARMSKFFVGSLDASEKPTQADSAYLRLCAEVNALLPKGSGGFAPPSYWLKAAALVVAAVSIEGYMLLRGKTLLLSVFLGLVFAWIQIQHDANHGALSRHSVINYCLGYAQDWIGGNMVLWLQEHVVMHHLHTNDVDADPDQKAHGVLRLKPTDGWMPWHALQQLYILPGEAMYAFKLLFLDALELLAWRWEGEKISPLARALFAPAVACKLGFWARFVPLWLQPTVHTALCICATVCTGSFYLAFFFFISHNFDGVGSVGPKGSLPRSATFVQRQVETSSNVGGYWLGVLNGQFQIEHHLFPRLHHSYYAQIAPVVRTHIEKLGFKYRHFPTVGSNLSSMLQHMGKMGWGAEKGGKAE

SEQ ID NO: 236 - protein, 467 aa, Artificial Sequence
  Synthetic Polypeptide
  MISC_FEATURE: D6NST0_9EUKA
MPPSAAKDAGGAAELRAAELASYTRKAVTERSDLTIVGDAVYDAKAFREEHPGGAHFVSLFGGRDATEAFMEYHRRAWPKARMSKFFVGSLAPSEKPTQVDEGYLRLCAEVNGLLPKGSGGFAPASYWLKAAALIVAALTLEGYMLLRGKTLFLSVLLGLVFAWIIQHDANHGALSRYPAVNYCLGYMQDWIGGNMVLWLQEHVVMHHLHTNDVDHDPDQKAHGALRLKPTDSWLPWHSLQQVYILPGEAMYAFKLLSLDALELLAWRWEGEPISQLAAPLYAPAVVCKLAFWARFPLWLQPSLHTAACICATVCTGSFYLAFFFFISHNFDGVASVGPQGSLSRSATFTQRQVETSSNVGGKWLAHLNGYQIEHHLFPRLHHSYYATIAPLVRQRIEAMGYKYSHFPTIGSNLGAMMSHLGKMAARPTSADKLARPSEKSSVECRLRLGAACSQASDAASLISWLG

SEQ ID NO: 237 - protein, 435 aa, Artificial Sequence
  Synthetic Polypeptide
  MISC_FEATURE: A0PJ29_9EUKA
MPPSAAKQMGASTGVHAGVTDSSAFTRKDVADRPDLTIVGDSVYDAKAFRSEHPGGAHFVSLFGGRDATEAFMEYHRRAWPKSRMSRFHVGSLASTEEPVAADEGYLQLCARIAKMVPSVSSGFAPASYWVKAGLILGSAIALEAYMLYAGKRLLPSIVLGWLFALIIQHDANHGALSKSASVNLALGLCQDWIGGSMILWLQEHVVMHHLHTNDVDKDPDQKAHGALRLKPTDAWSPMHWLQHLYLLPGETMYAFKLLFLDISELVMWRWEGEPISKLAGYLFMPSLLLKLTFWARFPLYLAPSVHTAVCIAATVMTGSFYLAFFFFISHNFEGVASVGPDGSITSMTRGASFLKRQAETSSNVGGPLLATLNGYQIEHHLFPRVHHGFYPRLAPLVKAELEIEYKHYPTIWSNLASTLRHMYALGRRPRSKAE

SEQ ID NO: 238 - protein, 445 aa, Artificial Sequence; identical to SEQ ID NO: 79
  Synthetic Polypeptide
  MISC_FEATURE: d4Des(Sa)

SEQ ID NO: 239 - protein, 519 aa, Artificial Sequence
  Synthetic Polypeptide
  MISC_FEATURE: d4Des(Tc)
MTVGYDEEIPFEQVRAHNKPDDAWCAIHGHVYDVTKFASVHPGGDIILLAAGKEATVLYETYHVRGVSDAVLRKYRIGKLPDGQGGANEKEKRTLSGLSSASYYTWNSDFYRVMRERVVARLKERGKARRGGYELWIKAFLLLVGFWSSLYWMCTLDPSFGAILAAMSLGVFAAFVGTCIQHDGNHGAFAQSRWVNKVAGWTLDMIGASGMTWEFQHVLGHHPYTNLIEEENGLQKVSGKKMDTKLADQESDPDVFSTYPMMRLHPWHQKRWYHRFQHIYGPFIFGFMTINKVVTQDVGVVLRKRLFQIDAECRYASPMYVARFWIMKALTVLYMVALPCYMQGPWHGLKLFAIAHFTCGEVLATMFIVNHIIEGVSYASKDAVKGTMAPPKTMHGVTPMNNTRKEVEAEASKSGAVVKSVPLDDWAAVQCQTSVNWSVGSWFWNHFSGGLNHQIEHHLFPGLSHETYYHIQDVVQSTCAEYGVPYQHEPSLWTAYWKMLEHLRQLGNEETHESWQRAA

SEQ ID NO: 240 - protein, 519 aa, Artificial Sequence
  Synthetic Polypeptide
  MISC_FEATURE: Q8S3C0_9STRA-Thraustochytrium_sp_ATCC21685
MTVGYDEEIPFEQVRAHNKPDDAWCAIHGHVYDVTKFASVHPGGDIILLAAGKEATVLYETYHVRGVSDAVLRKYRIGKLPDGQGGANEKEKRTLSGLSSASYYTWNSDFYRVMRERVVARLKERGKARRGGYELWIKAFLLLVGFWSSLYWMCTLDPSFGAILAAMSLGVFAAFVGTCIQHDGNHGAFAQSRWVNKVAGWTLDMIGASGMTWEFQHVLGHHPYTNLIEEENGLQKVSGKKMDTKLADQESDPDVFSTYPMMRLHPWHQKRWYHRFQHIYGPFIFGFMTINKVVTQDVGVVLRKRLFQIDAECRYASPMYVARFWIMKALTVLYMVALPCYMQGPWHGLKLFAIAHFTCGEVLATMFIVNHIIEGVSYASKDAVKGTMAPPKTMHGVTPMNNTRKEVEAEASKSGAVVKSVPLDDWAVVQCQTSVNWSVGSWFWNHFSGGLNHQIEHHLFPGLSHETYYHIQDVFQSTCAEYGVPYQHEPSLWTAYWKMLEHLRQLGNEETHESWQRAA

SEQ ID NO: 241 - protein, 518 aa, Artificial Sequence
  Synthetic Polypeptide
  MISC_FEATURE: Q45G27_9STRA-Thraustochytrium_sp_FJN-10
MTVGYDGEIPFEQVRAHNKPDDAWCAIHGHVYDVTKFASVHPGGIILLAAGKDATVLYETYHVRGVSDAVLRKYRIGKLPDGQGGANEKEKRTLSGLSSASYYTWNSDFYRVMRERVVARLKERGKARRGGYELWIKALLLLVGFWSSLCWMCTLDPSFGAILAAMSLGVFAAFVGTCIQHDGNHGAFAQSRWVNKVAGWTLDMIGASGMTWEFQHALGHHPYTNLIEEENGLQKVSGKKMDTKLADQESDPDVFSTYPMMRLHPWHQKRWYHRFQHIYGPFIFGFMTINKVVTQDVGVVFRKRLFQIDAECRYASPMYVARFWIMKALTVLYMVALPCYMQGPWHGLKLFAIAHFTCGEVLATMFIVNHVIEGVSYASKDAVKGTMAPPKTMHGVTPMNNTRKEVEAEASKSGAVVKSVPLDDWAAVQCQTSANWSVGSWFWNHFSGGLNHQIEHHLFPGLSHETYYHIQDVVQSTCAEYGVPYQHEPSLWTAYWKMLEHLRRLGNEETHESWQRAA

SEQ ID NO: 242 - protein, 515 aa, Artificial Sequence
  Synthetic Polypeptide
  MISC_FEATURE: Q8GZS4_9STRA-Thraustochytrium_aureum
MTVGFDETVTMDTVRNHNMPDDAWCAIHGTVYDITKFSKVHPGGDIIMLAAGKEATILFETYHIKGVPDAVLRKYKVGKLPQGKKGETSHMPTGLDSAFYYSWDSEFYRVLRERVAKKLAEPGLMQRARMELWAKAIFLLAGFWGSLYAMCVLDPHGGAMVAAVTLGVFAAFVGTCIQHDGSHGAFSKSRFMNKAAGWTLDMIGASAMTWEMQHVLGHHPYTNLIEMENGLAKVKGADVDPKKVDQESDPDVFSTYPMLRLHPWHRQRFYHKFQHLYAPFIFGFMTINKVISQDVGVVLRKRLFQIDANCRYGSPWYVARFWIMKLLTTLYMVALPMYMQGPAQGLKLFFMAHFTCGEVLATMFIVNHIIEGVSYASKDAVKGVMAPPRTVHGVTPMQVTQKALSAAESTKSDADKTTMIPLNDWAAVQCQTSVNWAVGSWFWNHFSGGLNHQIEHHCFPQNPHTVNVYISGIVKETCEEYGVPYQAEISLFSAYFKMLSHLRTLGNEDLTAWST

SEQ ID NO: 243 - protein, 515 aa, Artificial Sequence
  Synthetic Polypeptide
  MISC_FEATURE: Q8GZS5_9STRA-Thraustochytrium_aureum
MTVGFDETVTMDTVRNHNMPDDAWCAIHGTVYDITKFSKVHPGGDIIMLAAGKEATILFETYHIKGVPDAVLRKYKVGKLPQGKKGETSHMPTGLDSASYYSWDSEFYRVLRERVAKKLAEPGLMQRARMELWAKAIFLLAGFWGSLYAMCVLDPHGGAMVAAVTLGVFAAFVGTCIQHDGSHGAFSKSRFMNKAAGWTLDMIGASAMTWEMQHVLGHHPYTNLIEMENGLAKVKGADVDPKKVDQESDPDVFSTYPMLRLHPWHRQRFYHKFQHLYAPFIFGFMTINKVISQDVGVVLRKRLFQIDANCRYGSPWYVARFWIMKLLTTLYTVALPMYMQGPAQGLKLFFMAHFTCGEVLATMFIVNHIIEGVSYASKDAVKGVMAPPRTVHGVTPMQVTQKALSAAESTKSDADKTTMIPLNDWAAVQCQTSVNWAVGSWFWNHFSGGLNHQIEHHCFPQNPHTVNVYISGIVKETCEEYGVPYQAEISLFSAYFKMLSHLRTLGNEDLTARST

SEQ ID NO: 244 - protein, 515 aa, Artificial Sequence
  Synthetic Polypeptide
  MISC_FEATURE: Q8GZS6_9STRA-Thraustochytrium_aureum
MTVGFDETVTMDTVRNHNMPDDAWCAIHGTVYDITKFSKVHPGGDIIMLAAGKEATILFETYHIKGVPDAVLRKYKVGKLPQGKKGETSHMPTGLDSASYYSWDSEFYRVLRERVAKKLAEPGLMQRARMELWAKAIFLLAGFWGSLYAMCVLDPHGGAMVAAVTLGVFAAFVGTCIQHDGSHGAFSKSRFMNKAAGWTLDMIGASAMTWEMQHVLGHHPYTNLIEMENGLAKVKGADVDPKKVDQESDPDVFSTYPMLRLHPWHRQRFYHKFQHLYAPLIFGFMTINKVISQDVGVVLRKRLFQIDANCRYGSPWNVARFWIMKLLTTLYMVALPMYMQGPAQGLKLFFMAHFTCGEVLATMFIVNHIIEGVSYASKDAVKGVMAPPRTVHGVTPMQVTQKALSAAESTKSDADKTTMIPLNDWAAVQCQTSVNWAVGSWFWNHFSGGLNHQIEHHCFPQNPHTVNVYISGIVKETCEEYGVPYQAEISLFSAYFKMLSHLRTLGNEDLTAWST

SEQ ID NO: 245 - protein, 515 aa, Artificial Sequence
  Synthetic Polypeptide
  MISC_FEATURE: Q8GZS3_9STRA-Thraustochytrium_aureum
MTVGFDETVTMDTVRNHNMPDDAWCAIHGTVYDITKFSKVHPGGDIIMLAAGKEATILFETYHIKGVPDAVLRKYKVGKLPQGKKGETSHMPTGLDSASYYSWDSEFYRVLRERVAKKLAEPGLMQRARMELWAKAIFLLAGFWGSLYAMCVLDPHGGAMVAAVTLGVFAAFVGTCIQHDGSHGAFSKSRFMNKAAGWTLDMIGASAMTWEMQHVLGHHPYTNLIEMENGLAKVKGADVDPKKVDQESDPDVFSTYPMLRLHPWHRQRFYHKFQHLYAPFIFGSMTINKVISQDVGVVLRKRLFQIDANCRYGSPWYVARFWIMKLLTTLYMVALPMYMQGPAQGLKLFFMAHFTCGEVLATMFIVNHIIEGVSYASKDAVKGVMAPPRTVHGVTPMQVTQKALSAAESAKSDADKTTMIPLNDWAAVQCQTSVNWAVGSWFWNHFSGGLNHQIEHHCFPQNPHTVNVYISGIVKETCEEYGVPYQAEISLFSAYFKMLSHLRTLGNEDLTAWST

SEQ ID NO: 246 - protein, 550 aa, Artificial Sequence
  Synthetic Polypeptide
  MISC_FEATURE: B8LEI2_THAPS-Thalassiosira_pseudonana
MCNGNLPASTAQLKSTSKPQQQHEHRTISKSELAQHNTPKSAWCAVHSTPATDPSHSNNKQHAHLVLDITDFASRHPGGDLILLASGKDASVLFETYHPRGVPTSLIQKLQIGVMEEEAFRDSFYSWTDSDFYTVLKRRVVERLEERGLDRRGSKEIWIKALFLLVGFWYCLYKMYTTSDIDQYGIAIAYSIGMGTFAAFIGTCIQHDGNHGAFAQNKLLNKLAGWTLDMIGASAFTWELQHMLGHHPYTNVLDGVEEERKERGEDVALEEKDQESDPDVFSSFPLMRMHPHHTTSWYHKYQHLYAPPLFALMTLAKVFQQDFEVATSGRLYHIDANVRYGSVWNVMRFWAMKVITMGYMMGLPIYFHGVLRGVGLFVIGHLACGELLATMFIVNHVIEGVSYGTKDLVGGASHGDEKKIVKPTTVLGDTPMEKTREEALKSNSNNNKKKGEKNSVPSVPFNDWAAVQCQTSVNWSPGSWFWNHFSGGLSHQIEHHLFPSICHTNYCHIQDVVESTCAEYGVPYQSESNLFVAYGKMISHLKFLGKAKCE

SEQ ID NO: 247 - protein, 550 aa, Artificial Sequence
  Synthetic Polypeptide
  MISC_FEATURE: Q4G2T0_THAPS-Thalassiosira_pseudonana
MGNGNLPASTAQLKSTSKPQQQHEHRTISKSELAQHNTPKSAWCAVHSTPATDPSHSNNKQHAHLVLDITDFASRHPGGDLILLASGKDASVLFETYHPRGVPTSLIQKLQIGVMEEEAFRDSFYSWTDSDFYTVLKRRVVERLEERGLDRRGSKEIWIKALFLLVGFWYCLYKMYTTSDIDQYGIAIAYSIGMGTFAAFIGTCIQHDGNHGAFAQNKLLNKLAGWTLDMIGASAFTWELQHMLGHHPYTNVLDGVEEERKERGEDVALEEKDQESDPDVFSSFPLMRMHPHHTTSWYHKYQHLYAPPLFALMTLAKVFQQDFEVATSGRLYHIDANVRYGSVWNVMRFWAMKVITMGYMMGLPIYFHGVLRGVGLFVIGHLACGELLATMFIVNHVIEGVSYGTKDLVGGASHGDEKKIVKPTTVLGDTPMEKTREEALKSNSNNNKKKGEKNSVPSVPFNDWAAVQCQTSVNWSPGSWFWNHFSGGLSHQIEHHLFPSICHTNYCHIQDVVESTCAEYGVPYQSESNLFVAYGKMISHLKFLGKAKCE

SEQ ID NO: 248 - protein, 541 aa, Artificial Sequence
  Synthetic Polypeptide
  MISC_FEATURE: Q6WNG7_EUGGR-Euglena_gracilis
MLVLFGNFYVKQYSQKNGKPENGATPENGAKPQPCENGTVEKRENDTANVRPTRPAGPPPATYYDSLAVSGQGKERLFTTDEVRRHILPTDGWLTCHEGVYDVTDFLAKHPGGGVITLGLGRDCTILIESYHPAGRPDKVMEKYRIGTLQDPKTFYAWGESDFYPELKRRALARLKEAGQARRGGLGVKALLVLTLFFVSWYMWVAHKSFLWAAVWGFAGSHVGLSIQHDGNHGAFSRNTLVNRLAGWGMDLIGASSTVWEYQHVIGHHQYTNLVSDTLFSLPENDPDVFSSYPLMRMHPDTAWQPHHRFQHLFAFPLFALMTISKVLTSDFAVCLSMKKGSIDCSSRLVPLEGQLLFWGAKLANFLLQIVLPCYLHGTAMGLALFSVAHLVSGEYLAICFIINHISESCEFMNTSFQTAARRTEMLQAAHQAAEAKKVKPTPPPNDWAVTQVQCCVNWRSGGVLANHLSGGLNHQIEHHLFPSISHANYPTIAPVVKEVCEEYGLPYKNYVTFWDAVCGMVQHLRLMGAPPVPTNGDKKS

SEQ ID NO: 249 - protein, 438 aa, Artificial Sequence
  Synthetic Polypeptide
  MISC_FEATURE: F2U823_SALS5-Salpingoeca
MTTVVVDGRAYDGERFARVHPGGHTFVALYGGRDASDAFATYHRRRFPHEKMAQYRIEEKQQASTCALCVAEKEAGMTASTSSTCQQDEDFFELCKEVNSFLYKTHRNKGFAPTRYFAKAILLMALEMFFEYQLITAPTLLKGFVVGLLVALIGLNIQHDANHGSLSPKPWVNTLFGFAQDWIGGNSLLWLQQHVAIHHVECNDLDHDKDMLETPLLRFSPLHGKYAWQALQHVYFVLLEAGYATKVLLADWYNLLMNMYEGVPISPLVRPWRWWASVAARVVWTLRLIVIPLYLHSWQVYLPCLAVMAMVGGFYLAFFFLLSHNFEGVYHVLVPSSDPVNPKKALPNTLLGRQVLTSSNVGGALLAELNGGLNYQIEHHLFPRIHHNHYAAISPIVRRFCEKKGIAYVHFPTIWDNFKSTSNFLRAQGISSLMKRKV

SEQ ID NO: 250 - protein, 428 aa, Artificial Sequence
  Synthetic Polypeptide
  MISC_FEATURE: Q4QFK0_LEIMA-Leishmania_major
MNQCCHSHLSTLEPMPDLKKDVLSIDGIYYDTEKLALMHPGGAMVVRLCNGRECTAIFLSYHRRRFPHALYEKYQVPKDQVHPDSLIEQRQQPSYDSYLQLCKRIQPIIAPTKGFAPWYFYLKAATWLAVMLGLDLYSLFYRRAYFLTVIQSLSMAMVGLNVQHDANHGALSCDWRVNRILGLSQDLLGGSSISWIVNHDYVHHVYTNEPGRDADLEIPLLRLHSGIPVRLAHCLQQFYIFFLEAVFGPVHVLFNIIFLAKGPSEKQRLIKTQWVVSLCMLSIIPYRLLCNFLHATSFCDGLMSCVLQYAFGGFYLAYFFLLSHNFDGAKKVGTSDGQDFVACQVETSCNFGGWWWGQINGGLNFQIEHHLFPRVHHGYYAYLAPIVREFCEERGFTYTHYQTIKENMMSTFRHMEQYGRGREKRKSA

The invention claimed is:

1. A method for increasing the efficiency of eicosapentaenoic acid (EPA) production in a host cell capable of synthesizing EPA, the method comprising expressing in the cell a heterologous lysophospholipid-coenzyme A synthase (LACS) enzyme having at least 80% sequence identity to SEQ ID NO: 84 and fatty acyl CoA synthetase activity.

2. The method of claim 1, wherein a delta-5 elongase, a delta-6 elongase, a delta-5 desaturase, and/or a delta-6 desaturase is/are expressed in the cell.

3. A plant comprising a host cell capable of synthesizing EPA, the host cell comprising a polynucleotide encoding a heterologous LACS enzyme having at least 80% sequence identity to SEQ ID NO: 84 and fatty acyl CoA synthetase activity and further comprising one or more polynucleotides encoding a delta-5 elongase, a delta-6 elongase, a delta-5 desaturase, and/or a delta-6 desaturase.

4. A seed comprising a host cell capable of synthesizing EPA, the host cell comprising a polynucleotide encoding a heterologous LACS enzyme having at least 80% sequence identity to SEQ ID NO: 84 and fatty acyl CoA synthetase activity and further comprising one or more polynucleotides encoding a delta-5 elongase, a delta-6 elongase, a delta-5 desaturase, and/or a delta-6 desaturase.

5. A method for increasing the efficiency of docosahexaenoic acid (DHA) production in a host cell capable of synthesizing DHA, the method comprising expressing in the cell a heterologous lysophospholipid-coenzyme A synthase (LACS) enzyme having at least 80% sequence identity to SEQ ID NO: 84 and fatty acyl CoA synthetase activity.

6. The method of claim 5, wherein a delta-5 elongase, a delta-6 elongase, a delta-5 desaturase, and/or a delta-6 desaturase is/are expressed in the cell.

7. A plant comprising a host cell capable of synthesizing DHA, the host cell comprising a polynucleotide encoding a heterologous LACS enzyme having at least 80% sequence identity to SEQ ID NO: 84 and fatty acyl CoA synthetase activity and further comprising one or more polynucleotides encoding a delta-5 elongase, a delta-6 elongase, a delta-5 desaturase, and/or a delta-6 desaturase.

8. A seed comprising a host cell capable of synthesizing DHA, the host cell comprising a polynucleotide encoding a heterologous LACS enzyme having at least 80% sequence identity to SEQ ID NO: 84 and fatty acyl CoA synthetase activity and further comprising one or more polynucleotides encoding a delta-5 elongase, a delta-6 elongase, a delta-5 desaturase, and/or a delta-6 desaturase.

* * * * *